(12) United States Patent
Boyetchko et al.

(10) Patent No.: US 10,888,096 B2
(45) Date of Patent: Jan. 12, 2021

(54) BIOPESTICIDES FOR POTATO LATE BLIGHT DISEASE

(71) Applicant: Her Majesty the Queen in Right of Canada, as Represented By the Minister of Agriculture and Agri-Food, Saskatoon (CA)

(72) Inventors: Susan Boyetchko, Saskatoon (CA); Patrice Audy, Quebec (CA); Karen Sawchyn, Saskatoon (CA); Rejean Desgagnes, Quebec (CA); Ting Zhou, Guelph (CA); Tim Dumonceaux, Saskatoon (CA)

(73) Assignee: Her Majesty the Queen in Right of Canada, as Represented By the Minister of Agriculture and Agr, Saskatoon (CA)

( * ) Notice: Subject to any disclaimer, the term of this patent is extended or adjusted under 35 U.S.C. 154(b) by 52 days.

(21) Appl. No.: 16/077,400

(22) PCT Filed: Feb. 17, 2017

(86) PCT No.: PCT/CA2017/050157
§ 371 (c)(1),
(2) Date: Aug. 10, 2018

(87) PCT Pub. No.: WO2017/136944
PCT Pub. Date: Aug. 17, 2017

(65) Prior Publication Data
US 2019/0191708 A1 Jun. 27, 2019

Related U.S. Application Data

(60) Provisional application No. 62/294,068, filed on Feb. 11, 2016.

(51) Int. Cl.
*A01N 63/02* (2006.01)
*A01N 63/10* (2020.01)
*A01N 63/00* (2020.01)
*C12N 1/20* (2006.01)

(52) U.S. Cl.
CPC .............. *A01N 63/10* (2020.01); *A01N 63/00* (2013.01); *C12N 1/20* (2013.01)

(58) Field of Classification Search
CPC .................................. A01N 63/00; C12N 1/20
See application file for complete search history.

(56) References Cited

U.S. PATENT DOCUMENTS

2011/0077158 A1   3/2011   Slininger et al.

OTHER PUBLICATIONS

Partial Supplementary European Search Report dated Jul. 16, 2019, pp. 1-24.
A. Guyer et al.; "The Anti-Phytophthora Effect of Selected Potato-Associated Pseudomonas Strains: From the Laboratory to the Field"; Frontiers in Microbiology, Nov. 2015, vol. 6, Article 1309, pp. 1-13.
F. Daayf et al.; "Comparative screening of bacteria for biological control of potato late blight (strain US-8), using in-vitro, detached-leaves, and whole-plant testing systems"; Can. J. Plant Pathology. 25: 276-284 (2003).
International Search Report for PCT/CA2017/050157 dated May 4, 2017, pp. 1-6.
J. Hollywood; "Biological Control of Late Blight of Potatoes: in vivo and in vitro evaluation of microbial antagonists against tuber blight"; Thesis—Biology Department, University of London, published 2014, pp. 1-222.
J. Town et al.; "Genome Sequence of Pseudomonas chlororaphis Strain 189"; American Society for Microbiology; May/Jun. 2016, vol. 4, Issue 3, pp. 1-2.
J. Town et al.; "High-Quality Draft Genome Sequence of *Arthrobacter* sp. OY3WO11, a Strain That Inhibits the Growth of Phytophthora infestans"; American Society for Microbiology; May/Jun. 2016, vol. 4, Issue 3, pp. 1-2.
J. Town et al.; "High-Quality Draft Genome Sequence of Bacillus subtilis Strain WAUSV36"; American Society for Microbiology; May/Jun. 2016, vol. 4, Issue 3, pp. 1-2.
J. Town et al.; "High-Quality Draft Genome Sequence of Biocontrol Strain *Pantoea* sp. OXWO6B1"; American Society for Microbiology; May/Jun. 2016, vol. 4, Issue 3, pp. 1-2.
J. Town et al.; "Improved High-Quality Draft Genome Sequence of Pseudomonas fluorescens KENGFT3"; American Society for Microbiology; May/Jun. 2016, vol. 4, Issue 3, pp. 1-2.
N. Foran; "Bacterial antagonists as a biological solution for control of potato blight disease"; Thesis—McGill University, Montreal, Apr. 2016; pp. 1-89.
P.J. Slininger et al.; "Biological control of post-harvest late blight of potatoes"; Biocontrol Science and Technology, 2007; 17(5/6): 647-663.

*Primary Examiner* — Bin Shen
(74) *Attorney, Agent, or Firm* — Singleton Law, PLLC; Chainey P. Singleton

(57) ABSTRACT

Bacterial strains, or extracts thereof, are effective to control, treat or prevent infection of solanaceous plants with *Phytophthora infestans*, the causative agent of potato late blight disease. Also provided are biopesticidal formulations containing one or more of the bacterial strains or extracts thereof, and the use of the bacterial strains, extracts or biopesticidal formulations in the control, treatment and/or prevention of potato late blight disease.

24 Claims, 8 Drawing Sheets

Specification includes a Sequence Listing.

BIOPESTICIDES FOR POTATO LATE BLIGHT DISEASE

CROSS-REFERENCE TO RELATED APPLICATIONS

This application is a 371 of International Application No. PCT/CA2017/050157 filed on Feb. 17, 2017 which claims the benefit of U.S. Provisional Patent Application No. 62/294,068 filed Feb. 11, 2016.

BACKGROUND

The present application is directed to biopesticides for use in the treatment, control and/or prevention of potato late blight disease. More specifically, the present application is directed to bacterial strains which are useful in controlling the pathogen responsible for potato late blight disease.

Potato late blight disease, infamous for its implication in the Irish potato famine of the 1840s, is caused by infection of potato plants (*Solanum tuberosum* L.), and other solanaceous crops such as tomato and eggplant, by the pathogenic oomycete (water mold) *Phytophthora infestans* (Mont.) de Bary. The infection is characterized by black/brown lesions on the stems and leaves of the plant, which expand rapidly and become necrotic. Harvested afflicted potato tubers can decay upon storage or, if they survive the winter in storage or in the soil, can spread the disease to the next year's crop.

Current control measures involve an integrated pest management approach, including population monitoring of the pathogen, preventive measures such as crop rotation and sanitation (elimination or exclusion of infected plant parts from a farm), development of resistant crop varieties, and the use of chemical fungicides, which can require up to 12-15 applications per season, at a cost of millions of dollars. However, *Phytophthora infestans* is highly adaptive, and various new genotypes have developed resistance to the major fungicides, including metalaxyl and mefenoxam, or the ability to overcome resistance in crops. Thus, potato late blight disease is an ongoing problem and the world's most economically significant potato and tomato disease, contributing to an estimated global annual cost of over $6.7 billion for crop losses and other control measures.

Biopesticides, which are formulations containing naturally-occurring microorganisms that kill, suppress or reduce the vigor of a target pest, are a desirable alternative to chemical pesticides and other pest control mechanisms. Such biopesticides typically show lower human and mammalian toxicity, do not survive outside of their natural host or persist in the environment, and are generally regarded as safe. The microorganism component of a biopesticide is usually a bacterium, fungus or virus in a form which can propagate and infect the target pest, once applied. The microorganism can be host-specific to a particular species of pest, or have broad spectrum activity against a range of pest species. Mass production of such microorganisms using large-scale fermentation technology has contributed to the commercial viability of biopesticide production and use.

Therefore, microorganisms and biopesticidal formulations thereof which can be used to control potato late blight disease are desirable.

SUMMARY

In one aspect, the present invention provides a bacterial culture effective to control, treat or prevent potato late blight disease in plants. In at least one embodiment, the bacterial culture comprises one or more bacteria selected from *Pseudomonas chlororaphis* strain 189, *Bacillus subtilis* strain WAUSV36, *Pseudomonas fluorescens* strain UWO1, *Pseudomonas fluorescens* strain KENGFT3, *Arthrobacter* sp. strain OY3WO11 and *Pantoea* sp. strain OXWO6B1.

Another aspect of the present invention provides an extract from a bacterial culture as described herein, wherein the extract is effective to control, treat or prevent potato late blight disease in plants.

In another aspect, the present invention provides a biopesticidal formulation which is effective to control, treat or prevent potato late blight disease in plants comprising a bacterial culture as described herein, or an extract thereof, and a carrier.

A further aspect of the present invention provides the use of a bacterial culture or a biopesticidal formulation as described herein for control, treatment and/or prevention of potato late blight disease in plants.

Yet another aspect of the present invention provides a method of controlling, treating or preventing potato late blight disease in plants, the method including applying a bacterial culture as described herein, or an extract thereof, or a biopesticidal formulation thereof, to a plant, or part thereof, infected by, or at risk of infection by, *Phytophthora infestans*.

BRIEF DESCRIPTION OF THE DRAWINGS

Further features of the present invention will become apparent from the following written description and the accompanying figures, in which.

DETAILED DESCRIPTION

Figure 1:
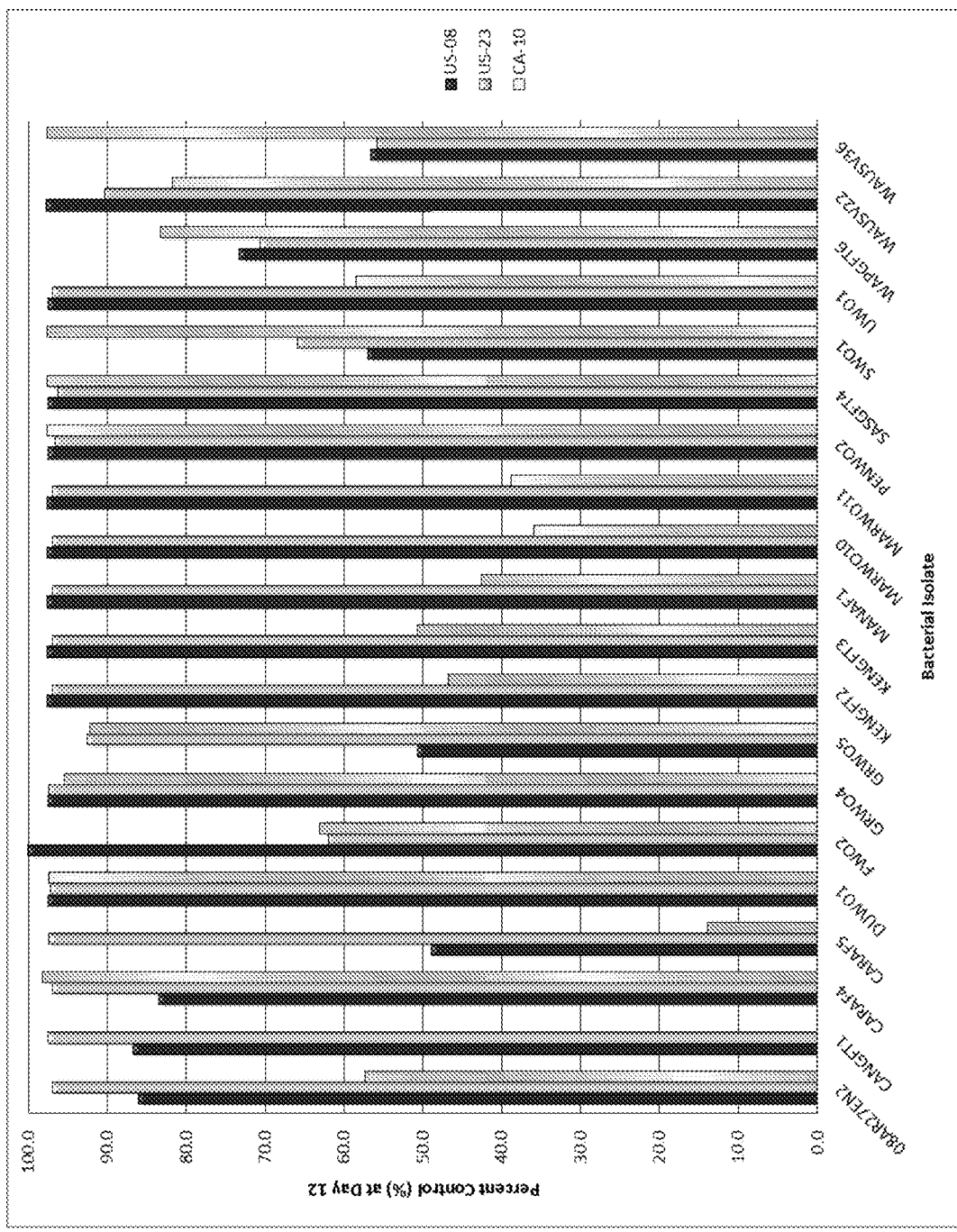
FIG. 1 is a bar graph showing the percent control of growth of *Phytophthora infestans* genotypes US-08, US-23 and CA-10 by various bacterial strains in vitro.

The present invention provides one or more strains of bacteria, or a culture thereof, which are useful as biopesticides against the pathogen *Phytophthora infestans*, the causative agent for potato late blight disease. Bacterial strains were obtained for initial screening from a culture collection established by Dr. Susan Boyetchko (Agriculture and Agri-Food Canada). Bacteria in the collection were isolated and purified from rhizosphere soils, roots or seeds collected from across the Canadian prairies. In at least one embodiment, the bacterial strain is selected from *Pseudomonas chlororaphis* strain 189, *Bacillus subtilis* strain WAUSV36, *Pseudomonas fluorescens* strain UWO1, *Pseudomonas fluorescens* strain KENGFT3, *Arthrobacter* sp. strain OY3WO11 and *Pantoea* sp. strain OXWO6B1.

A deposit of *Pseudomonas chlororaphis* strain 189 pursuant to the Budapest Treaty was received on Nov. 17, 2016 by the International Depositary Authority of Canada (IDAC), National Microbiology Laboratory, Public Health Agency of Canada, 1015 Arlington Street, Winnipeg, Manitoba, Canada R3E 3R2 (Accession number: 151116-02). The full genome of *Pseudomonas chlororaphis* strain 189 has been deposited at DDBJ (DNA Databank of Japan)/EMBL (European Molecular Biology Laboratory European Nucleotide Archive (ENA))/GenBank under accession number CP014867 (Town et al., *Genome Announcements* (May/June 2016) 4(3): e00581-16).

A deposit of *Bacillus subtilis* strain WAUSV36 was received by IDAC on Nov. 17, 2016 (Accession number: 151116-01). A draft genome sequence of *Bacillus subtilis* strain WAUSV36 has been deposited at DDBJ/EMBL/GenBank under accession numbers LWLQ00000000 and LWLQ01000000 (Town et al., *Genome Announcements* (May/June 2016) 4(3): e00586-16).

A deposit of *Pseudomonas fluorescens* strain UWO1 was received by IDAC on Nov. 17, 2016 (Accession number: 151116-03).

A deposit of *Pseudomonas fluorescens* strain KENGFT3 was received by IDAC on Nov. 17, 2016 (Accession number: 151116-05). A draft genome sequence of *Pseudomonas fluorescens* strain KENGFT3 has been deposited at DDBJ/EMBL/GenBank under accession number CP014868 (Town et al., *Genome Announcements* (May/June 2016) 4(3): e00428-16).

A deposit of *Arthrobacter* sp. strain OY3WO11 was received by IDAC on Nov. 17, 2016 (Accession number: 151116-04). A draft genome sequence of *Arthrobacter* sp. strain OY3WO11 has been deposited at DDBJ/EMBL/GenBank under accession numbers LWLP00000000 and LWLP01000000 (Town et al., *Genome Announcements* (May/June 2016) 4(3): e00585-16).

A deposit of *Pantoea* sp. strain OXWO6B1 was received by IDAC on Nov. 17, 2016 (Accession number: 151116-06). A draft genome sequence of *Pantoea* sp. strain OXWO6B1 has been deposited at DDBJ/EMBL/GenBank under accession numbers LWLR00000000 and LWLR01000000 (Town et al., *Genome Announcements* (May/June 2016) 4(3): e00582-16).

In at least one embodiment, the bacterial strain is effective to control, treat or prevent potato late blight disease in one or more solanaceous crops. In at least one embodiment, the bacterial strain is effective to control, treat or prevent infection of one or more solanaceous crops by *Phytophthora infestans*. In at least one embodiment, the solanaceous crop is potato. In at least one embodiment, the solanaceous crop is tomato.

The present invention also provides an extract from one or more biopesticidal bacterial strains as described herein. In at least one embodiment, the extract is an extract of a culture medium in which the one or more biopesticidal bacterial strains have grown. In at least one embodiment, the extract is a cell-free extract. In at least one embodiment, the cell-free extract contains one or more compounds having antifungal activity against *Phytophthora infestans*. In at least one embodiment, the one or more compounds having antifungal activity against *Phytophthora infestans* are bacterial secondary metabolites. In at least one embodiment, the extract of the bacterial strain is effective to control, treat or prevent potato late blight disease in one or more solanaceous crops, or to control, treat or prevent infection of one or more solanaceous crops by *Phytophthora infestans*.

Without being limited by theory, it is contemplated that the bacterial culture, or extract thereof, can exert antifungal activity against *Phytophthora infestans* by one or more mechanisms. In at least one embodiment, the bacteria can act to induce or prevent the expression of one or more genes in *Phytophthora infestans*, thereby causing an antifungal effect. In at least one embodiment, the bacteria can produce one or more compounds, including but not limited to secondary metabolites, which can exert antifungal activity against *Phytophthora infestans*. In at least one embodiment, the bacteria can act to induce resistance in the host plant to infection by *Phytophthora infestans*. In at least one embodiment, the bacteria can act to induce the expression of one or more genes in the host plant which cause the host plant to be more resistant to infection by *Phytophthora infestans* than the host plant would be in the absence of the bacteria. In at least one embodiment, the bacteria can act to prevent the expression of one or more genes in the host plant which cause the host plant to be more susceptible to infection by *Phytophthora infestans* than the host plant would be in the presence of the bacteria.

In at least one embodiment, the bacterial strain, or an extract thereof, including but not limited to a cell-free extract thereof, can be formulated into a biopesticidal formulation for application to solanaceous crops in danger of infection by *Phytophthora infestans* or of potato late blight disease. In at least one embodiment, the biopesticidal formulation comprises the bacterial strain or extract thereof and one or more agriculturally acceptable carriers. Other additives known in the art which can beneficially modify the properties of the formulation can also be present. Such additives can, for example, modify or improve one or more of the convenience or ease of handling or application, efficacy, safety or cost effectiveness of the formulation. The skilled person would be aware of ways in which to prepare such formulations and to test the prepared formulations for efficacy, in light of the further teachings herein.

Also contemplated is a method of controlling, treating or preventing potato late blight disease in plants. The method includes applying a bacterial culture as described herein, or an extract thereof, or a biopesticidal formulation thereof, to a plant, or part thereof, infected by, or at risk of infection by, *Phytophthora infestans*. The bacterial culture, extract thereof, or biopesticidal formulation thereof can be in any form useful for such application, as known in the art, and can be applied by any known method, and at any stage in the plant lifecycle at which application of the bacterial culture, extract thereof, or biopesticidal formulation thereof will be effective at controlling, treating or preventing potato late blight disease or infection by *Phytophthora infestans*.

In at least one embodiment, the bacterial culture, extract thereof, or biopesticidal formulation thereof is applied by spraying. In at least one embodiment, the bacterial culture, extract thereof, or biopesticidal formulation thereof is applied to plants growing in the field. In at least one embodiment, the bacterial culture, extract thereof, or biopesticidal formulation thereof is applied to plants under cultivation, including but limited to cultivation in greenhouses or glasshouses. In at least one embodiment, the bacterial culture, extract thereof, or biopesticidal formulation thereof is applied to tubers prior to or during storage. In at least one embodiment, the tubers are potato tubers. In at least one embodiment, the bacterial culture, extract thereof, or biopesticidal formulation thereof is applied to fruit before harvest. In at least one embodiment, the bacterial culture, extract thereof, or biopesticidal formulation thereof is applied to fruit after harvest. In at least one embodiment the fruit is tomato fruit.

EXAMPLES

Other features of the present invention will become apparent from the following non-limiting examples which illustrate, by way of example, the principles of the invention.

Example 1

Culture of Microorganisms

Bacterial Suspensions:

Bacterial cultures maintained at −80° C. are thawed and grown on *Pseudomonas Agar* F media (Difco™ pancreatic digest of casein (10.0 g), proteose peptone No. 3 (10.0 g), $K_2HPO_4$ (1.5 g), $MgSO_4$ (1.5 g), agar (15.0 g) and glycerol (10 g) in water (1 L)). Colonies are inoculated into 125 mL of yeast extract glucose medium (YGM; yeast extract (2.0 g), dextrose (2.5 g), buffer solution (10 mL, $KH_2PO_4$ (25.0 g/L) and $K_2HPO_4$ (25.0 g/L)), and saline solution (10 mL, $MgSO_4.7H_2O$ (10.0 g/L), $MnSO_4.H_2O$ (1.5 g/L), NaCl (5.0 g/L) and $FeSO_4.7H_2O$ (0.5 g/L)) in water (1 L total volume)) and incubated for 48 h on a rotary shaker (150 rpm) in 500 mL baffled flasks at 22° C. to provide bacterial suspensions.

Cell-Free Bacterial Filtrates:

Bacterial suspensions are centrifuged at 10,000 rpm for 10 minutes and the supernatant is vacuum filtered through a 0.22 μm non-protein binding filter to provide cell-free bacterial filtrates.

*Phytophthora infestans* Cultures

*Phytophthora infestans* isolates genotypes CA-10 (A1 mating type from tomato), US-08 (A2 mating type from potato) and US-23 (A1 mating type from potato) are used for in vitro testing. *Phytophthora infestans* isolates genotypes CA-09 (A1 mating type from tomato), CA-10 (A1 mating type from tomato), US-08 (A2 mating type from potato and US-22 (A2 mating type from tomato) are used for in vivo testing. All *Phytophthora infestans* isolates are maintained on Rye Seed A agar (RSA) (Caten, C. E. and J. L. Jinks. "Spontaneous variability of single isolates of *Phytophthora infestans*. I. Cultural variation." *Can. J. Bot.* (1968) 46: 329-348).

Example 2

In Vitro Bioassays

Bacterial Suspensions

An agar plug (0.5 cm diameter) of *Phytophthora infestans* (A1 or A2 mating types) is placed in the centre of a Petri dish (9 cm diameter) containing Rye Seed A agar (RSA). An aliquot (2 μL) of bacterial suspension is placed near the edge of the plate; 2-4 bacterial strains are tested on each plate. Zones of inhibition are measured after incubation at 15° C. for 7 days. Experiments are conducted twice, using four replicates each.

Cell-Free Bacterial Filtrates

Cell-free bacterial filtrates, or sterile water as a negative control, are dispensed in agar (50%, v/v). A mycelial plug of the pathogen is placed in the centre of a Petri dish (9 cm diameter) and mycelial growth is measured after incubation at 22° C. for 7 and 12 days. Experiments are conducted twice, using four replicates each. Results are analyzed using SAS™ software. Percent control (%) is calculated as follows:

Percent Control (%)=100−(B/C×100)

where B is the mean growth observed in the presence of bacterial filtrate at Day 7 or Day 12 and C is the mean growth observed in the presence of sterile water (control) at Day 7 or Day 12.

Results

Bacterial strains from a culture collection established by Dr. Susan Boyetchko (Agriculture and Agri-Food Canada) originating from a variety of soils and plant roots collected from the Canadian prairies and representing diverse taxonomic groups were tested as bacterial suspensions in the in vitro assay described above. Forty-six strains showed activity in this assay and were selected for further testing. FIG. 1 shows the percent control at Day 12 for cell-free filtrates of 20 of these selected bacterial strains against genotypes CA-10 (A1, tomato), US-08 (A2, potato) and US-23 (A1, potato) of *Phytophthora infestans*. As seen from FIG. 1, most of the cell-free extracts of the bacterial strains tested show significant inhibitory activity against one or more genotypes of *Phytophthora infestans*.

Example 3

In Vivo Fed Detached Leaf Bioassay

Potato leaves containing 5 leaflets each are selected and grown in 50 mL test tubes containing 10% Hoagland's solution (Hoagland, D. R., and Arnon, D. I. "The water-culture method for growing plants without soil" Univ. Calif. Coll. Agric. Exp. Sta. Circ. Berkeley, Calif. (1938), 347-353). The leaves are dipped in the selected test or control treatment as described below, followed 2 h later by spraying until runoff with a suspension of *Phytophthora infestans*. Treated leaves are incubated at 22° C. under high humidity conditions (86-92% relative humidity) and a photoperiod of 16 h day/8 h night.

Disease progression and severity on leaves are measured after 7 and 10 days incubation by estimating the proportion of photosynthetic area affected by the pathogen (James, 1971: James, W. C. An Illustrated Series of Assessment Keys for Plant Diseases, their Preparation and Usage. *Canadian Plant Disease Survey* (1971) 51(2), 39-65). The area of disease coverage is scored individually (out of a maximum of 20) for each of the five leaflets, and the scores for the individual leaflets are added to give a total score (out of a maximum of 100) for each leaf. The percent disease severity is determined by dividing the disease severity rating of treated leaves by the disease severity rating of leaves exposed to pathogen alone, and multiplying the result by 100%.

Results

The forty-six selected bacterial strains were tested in the in vivo fed detached leaf bioassay described above, using 12 leaves per treatment. Experiments were replicated twice. Each set of 12 leaves was treated by dipping in one of a bacterial suspension prepared as in Example 1, a cell-free bacterial filtrate prepared as in Example 1, an autoclaved (20 minutes, 121 psi) bacterial suspension, or YGM medium alone (control), prior to exposure to *Phytophthora infestans* (10,000 sporangia/mL; US-08 isolate).

Figure 2:
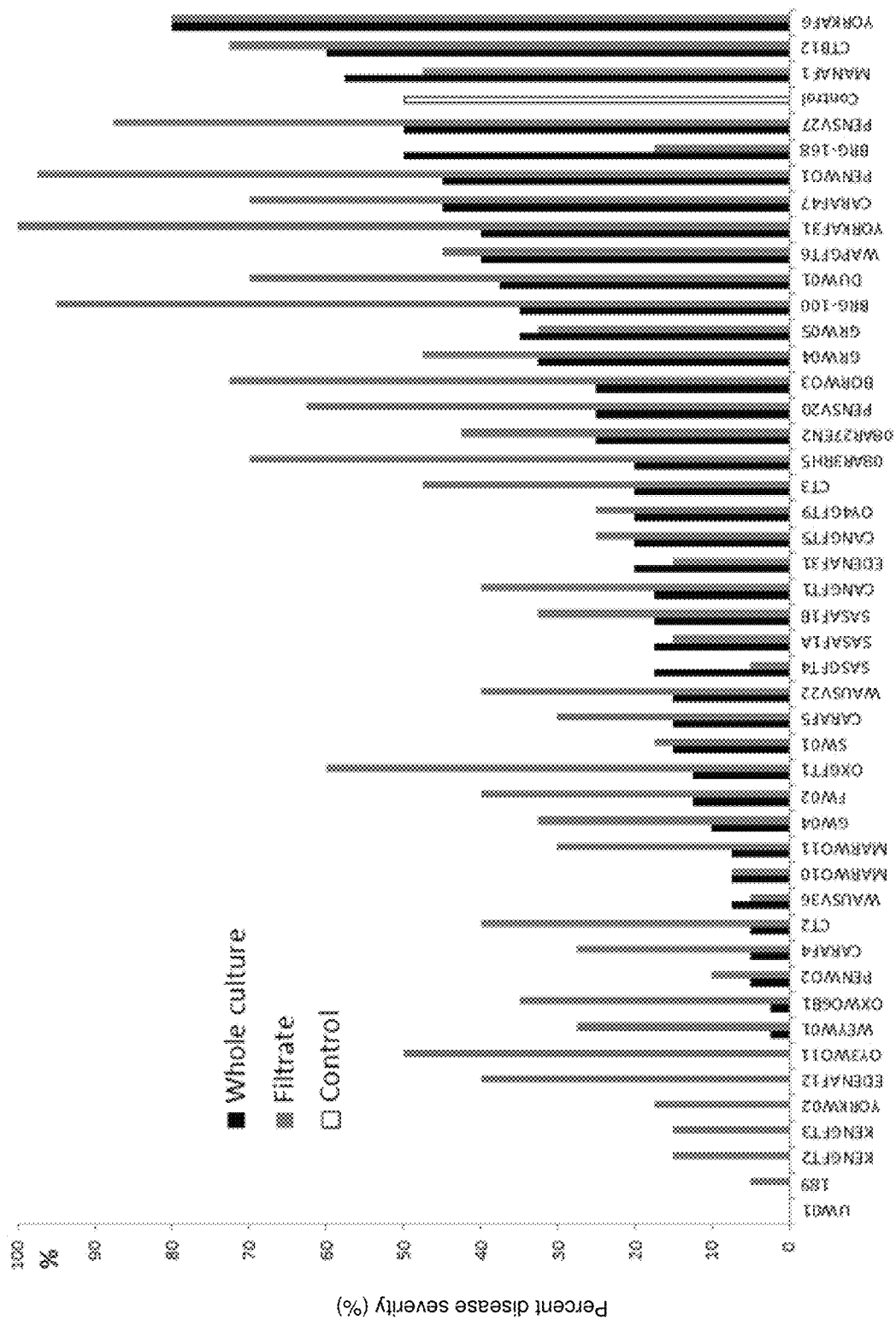
FIG. 2 is a bar graph showing the percent disease severity in potato leaves infected with *Phytophthora infestans* genotype US-08 in the presence of various bacterial suspensions and cell-free bacterial filtrates.
Figure 3:
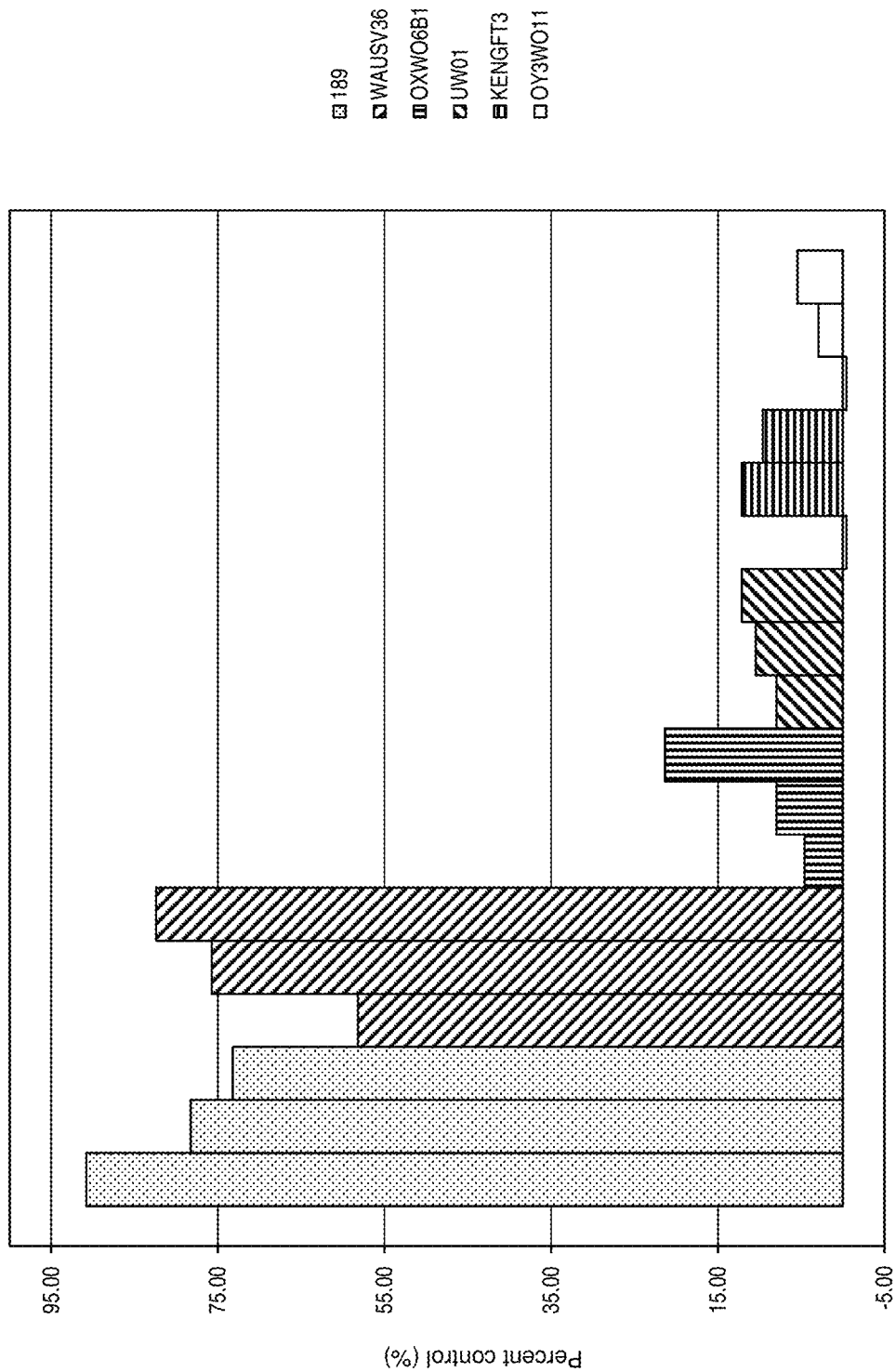
FIG. 3 is a bar graph showing the percent control of growth of *Phytophthora infestans* genotype CA-09 (A1) in potato leaves 10 days after infection in the presence of various bacterial suspensions.
Figure 4:
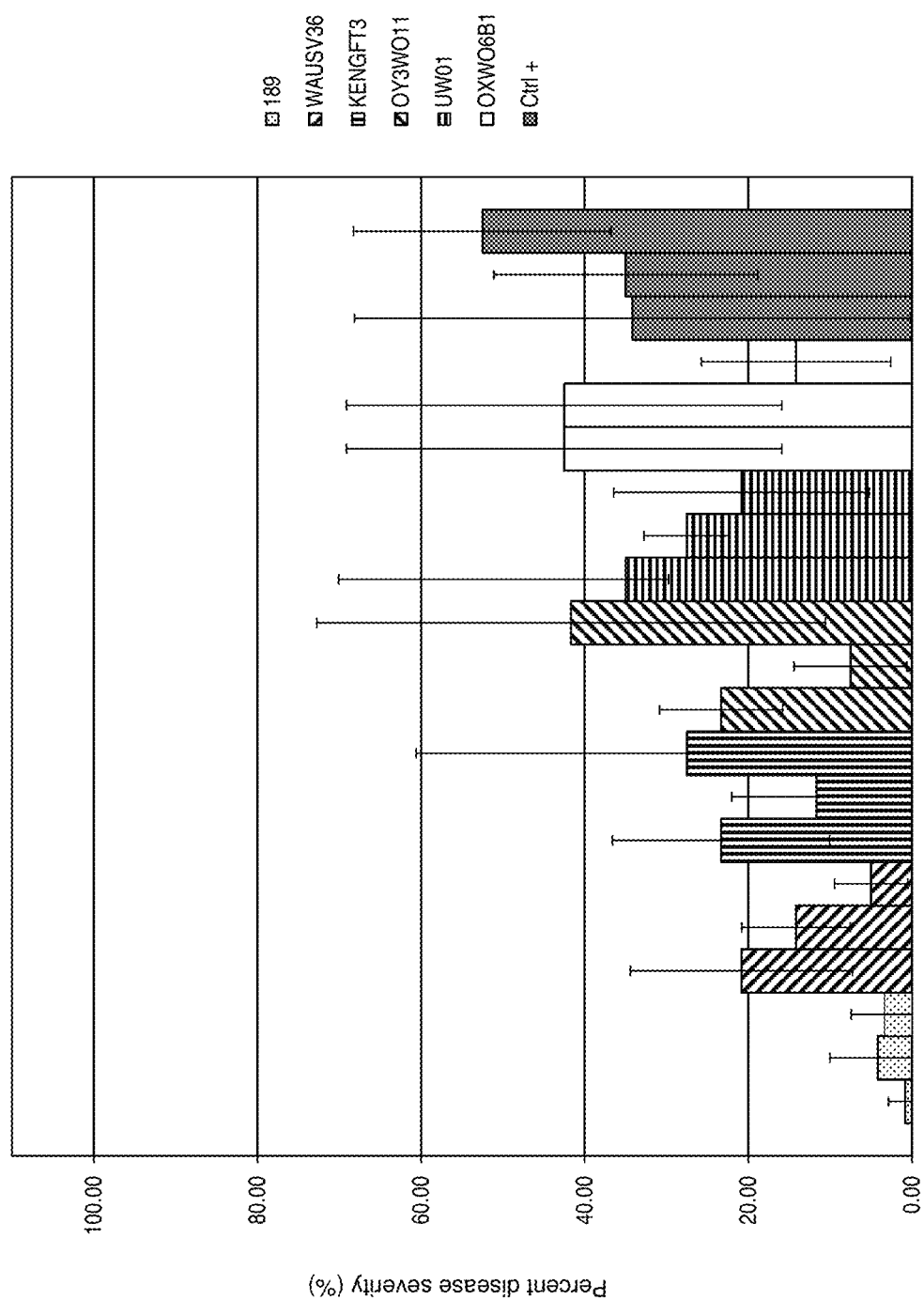
FIG. 4 is a bar graph showing the percent disease severity in potato leaves infected with *Phytophthora infestans* genotype US-22 (A2) 7 days after infection in the presence of various bacterial suspensions.
Figure 5:
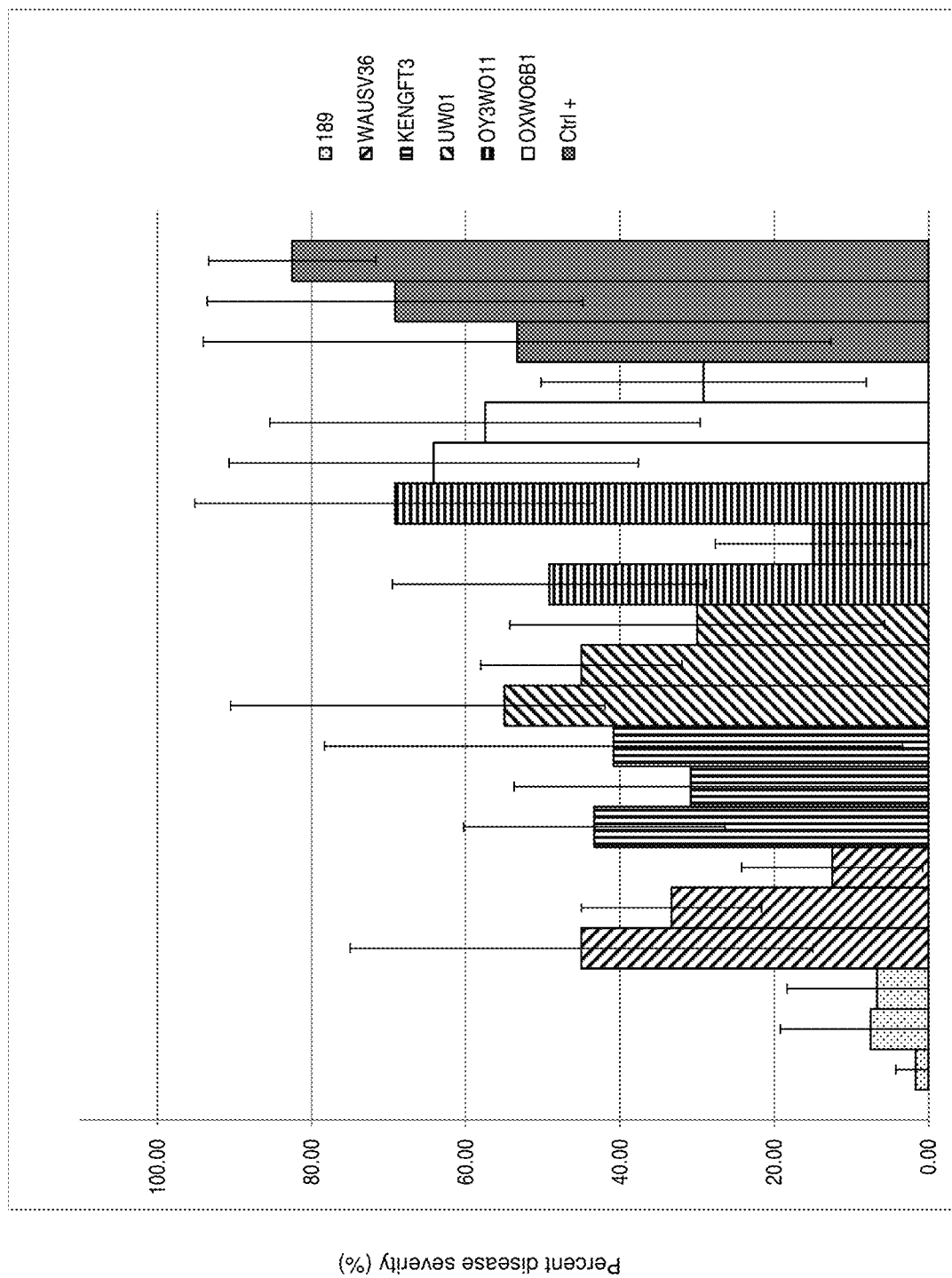
FIG. 5 is a bar graph showing the percent disease severity in potato leaves infected with *Phytophthora infestans* genotype US-22 (A2) 10 days after infection in the presence of various bacterial suspensions.

FIG. 2 shows the percent disease severity of infected leaves treated with bacterial suspensions and cell-free bacterial filtrate from 46 test bacterial strains 10 days after treatment and inoculation with *Phytophthora infestans*. The bacterial strains are arranged in order of increasing disease severity of leaves exposed to whole culture (bacterial suspension), from left to right. Thus, bacterial strains for which the whole culture is most effective against *Phytophthora infestans* are identified at the left of the chart.

Six bacterial strains were selected for further investigation, based on the effects of whole bacterial cultures to control disease severity caused by *Phytophthora infestans*. The six bacterial strains were tested in the in vivo fed detached leaf bioassay described above, using 18 leaves per treatment. Experiments were replicated four times. Each set of 18 leaves was treated by dipping in a 48-hour bacterial suspension prepared as in Example 1, or distilled water, prior to exposure to *Phytophthora infestans* (7,000 sporangia/mL). Each of the CA-09 (A1), CA-10 (A1), US-08 (A2) and US-22 (A2) genotypes of *Phytophthora infestans* was tested in a separate experiment. The percent disease severity of leaves exposed to *Phytophthora infestans* (US-08 (A2) isolate) in the presence of the six selected bacterial strains is shown in Table 1.

TABLE 1

| | Bacterial strains | | | | | |
|---|---|---|---|---|---|---|
| Treatment | UW01 | KENGFT3 | OY3WO11 | 189 | OXWO6B1 | WAUSV36 |
| Bacterial suspension + Pathogen | 0 | 2 | 2 | 1 | 5 | 7 |
| Cell-free bacterial filtrate + Pathogen | 1 | 15 | 52 | 7 | 36 | 8 |
| Autoclaved culture + Pathogen | 39 | 75 | 39 | 23 | 37 | 0 |
| Pathogen Alone | 23 | 82 | 58 | 23 | 58 | 33 |

As seen from the data in Table 1, all six bacterial strains protect potato leaves from the effects of infection by *Phytophthora infestans* genotype US-08 (A2) when applied as a bacterial suspension. In addition, cell-free isolates of strains UWO1, KENGFT3, 189 and WAUSV3 show significant protection of potato leaves from the effects of infection by *Phytophthora infestans* genotype US-08 (A2).

As can be seen from FIG. 3, strains 189 and WAUSV36 show the best percent control of growth of *Phytophthora infestans* genotype CA-09 (A1). As well, FIGS. 4 and 5 show that strain 189 protects potato leaves against infection with *Phytophthora infestans* genotype US-22 (A2) better than the five other strains tested. Table 2 shows a comparison of the efficacy of treatment with bacterial suspensions of each of the six tested bacterial strains against four genotypes of *Phytophthora infestans* compared to treatment with distilled water (control). SS indicates that the results from treatment with the bacteria are statistically significantly better than those from treatment with control at the p=0.01 level; NSS indicates that the difference between treatment with bacteria and control is not statistically significant at the p=0.01 level.

TABLE 2

| Bacterial | *Phytophthora infestans* genotype | | | |
|---|---|---|---|---|
| strains | US-08 (A2) | CA-10 (A1) | CA-09 (A1) | US-22 (A2) |
| 189 | SS | SS | SS | SS |
| WAUSV36 | SS | SS | SS | NSS |
| KENGFT3 | SS | SS | NSS | NSS |
| UW01 | SS | SS | NSS | NSS |
| OXWO6B1 | SS | NSS | NSS | NSS |
| OY3WO11 | SS | NSS | NSS | NSS |

Example 4

Identification of Bacteria

Bacterial suspensions (200 μL, prepared as in Example 1) are boiled for 5 min, then cooled to room temperature and centrifuged. The supernatant (2 μL) is subjected to PCR (polymerase chain reaction) conditions to amplify the internal transcribed spacer (ITS) and chaperonin 60 universal target (cpn60 UT) regions of the bacterial genome. ITS regions are amplified and bands are sized to group similar strains, so as to avoid repetitive sequencing of highly similar or identical cpn60 UT sequences from closely related strains.

ITS amplicons are generated with primers ITS-F and ITS-R as described in Schellenberg et al., "Selection, phenotyping and Identification of acid and hydrogen peroxide producing bacteria from vaginal samples of Canadian and East African women." PLoS One (2012) 7(7): e41217. Bands are sized by electrophoresis on a polyacrylamide gel (4-20% gradient gels, Invitrogen) and post-stained using SYBR™ Green I stain (Invitrogen). Gels are imaged with a Bio-Rad gel imager and bands are sized by comparison to molecular weight markers.

The cpn60 UT sequences of bacterial isolates are determined by directly sequencing amplicons generated using M13-adapted universal primers H729/H730 as described in Goh et al., "Identification of *Enterococcus* species and phenotypically similar *Lactococcus* and *Vagococcus* species by reverse checkerboard hybridization to chaperonin 60 gene sequences." Journal of Clinical Microbiology (2000) 38: 3953-3959. Samples with higher G/C content (e.g. *Pseudomonas* spp.) were amplified successfully using M13-adapted cpn60 UT "magic" primers H1594: (5'-CGCCAGGGTTTTCCCAGT-CACGACGACGTCGCCGGTGACGGCACCACCAC-3' (SEQ ID NO:1) and H1595:
5'-AGCGGATAACAATTTCACACAGGACGA CGGTCGCCGAAGCCCGGGGCCTT-3' (SEQ ID NO:2) (primers courtesy of Dr. Sean Hemmingsen, National Research Council of Canada). PCR conditions include 1U Taq DNA polymerase (Invitrogen), 2.5 mM $MgCl_2$, 500 nM of each dNTP, and 400 nM of each of forward and reverse primer sets, for one cycle at 95° C. for 3 min and 40 cycles at 95° C. for 30 sec, 50° C. for 30 sec, and 72° C. for 30 sec.

In some cases, amplicons are generated with a 3:1 molar ratio of primers H1612-H1613 and H279-H280, as described in Hill et al., "Improved template representation in cpn60 polymerase chain reaction (PCR) product libraries generated from complex templates by application of a specific mixture of PCR primers." Environmental Microbiology (2005) 8: 741-746, and are cloned into a pGEM™-T Easy vector (Promega) prior to sequencing. Amplicons are purified using QiaQuick™ PCR purification kit (Qiagen) or using Amicon™ YM-30 ultrafiltration membranes (Fisher), and sequenced. Plasmids are prepared with a QuickLyse™ plasmid kit (Qiagen) prior to sequencing.

Results

Some bacterial strains which were found to be effective at controlling *Phytophthora infestans* infection were identified by comparing the sequences of the chaperonin 60 universal target (cpn60 UT) regions of the bacterial genome to corresponding sequences from known bacterial strains. Initial identification is carried out by comparison to reference databases, including but not limited to the chaperonin database (Hill J. E. et al., "cpnDB: a chaperonin sequence database" *Genome Res*. (2004) 14:1669-1675) and the National Center for Biotechnology Information (NCBI) database, complemented by the construction of phylogenetic trees. Based on this comparison, the six bacterial strains selected for further investigation were identified as follows:

189 *Pseudomonas chlororaphis* strain 189
KENGFT3 *Pseudomonas fluorescens* strain KENGFT3
OXWO6B1 *Pantoea* sp. strain OXWO6B1
OY3WO11 *Arthrobacter* sp. strain OY3WO11
UWO1 *Pseudomonas fluorescens* strain UWO1
WAUSV36 *Bacillus subtilis* strain WAUSV36

Example 5

Sequencing of Bacterial Genomes

*Pseudomonas chlororaphis* Strain 189

Genomic DNA was purified from 1 mL of an overnight culture in YGM (Example 1) of *Pseudomonas chlororaphis* strain 189 using a Wizard genomic DNA (gDNA) extraction kit (Promega, Madison, Wis., USA) and sequenced on the MiSeq platform using the mate-pair protocol (Illumina), generating 2.8 Mb of mate-pair reads. An additional 8-kb insert paired-end sequencing run was performed based on the paired-end rapid library preparation protocol for Titanium chemistry (Roche, March 2012), with modifications as described (Hill et al., Protocol Exchange (2014) doi: 10.1038/protex.2014.028), generating 166,514 paired-end reads with an estimated pair distance of 5,641±1,410 bp.

Illumina reads were assembled using SOAPdenovo2 version 2.01 (Luo et al.: SOAPdenovo2: an empirically improved memory-efficient short-read de novo assembler. GigaScience (2012) 1: 18.) with k-mer size 127 and map length 34. The resulting 957 contigs ($N_{50}$ 33,267 bp) were split into 500-bp pieces with a 200-bp overlap using EMBOSS splitter, combined with the Roche paired-end reads, and reassembled using Newbler version 3.0 (454 Life Sciences). Gaps in the sequence were filled using the GapCloser tool for SOAPdenovo2, along with PCR and Sanger sequencing. Assembly of all sequencing data together produced a finished 6.8-Mbp genome sequence (SEQ ID NO:3) with 152× coverage, featuring a single scaffold with no gaps and no evidence of any plasmids. Sequence data were annotated using the Prokaryotic Genome Annotation Pipeline version 3.1 (NCBI).

The genome of *Pseudomonas chlororaphis* strain 189 contains 6,837,781 bp (62.74% G/C); 6,025 genes and 5,934 protein-encoding genes were observed, along with 6 genes encoding 5S rRNA, 5 genes encoding 16S rRNA, 5 genes encoding 23S rRNA, and 71 tRNA-encoding genes. Moreover, 2,075 clusters of orthologous groups were identified by annotation using the Integrated Microbial Genomes portal.

Examination of the cpn60 sequence of*Pseudomonas chlororaphis* strain 189 suggests that this strain is most closely related to *Pseudomonas chlororaphis* subsp. *aureofaciens* 30-84 (NZ_CM001559.1), with a nucleotide identity of 99.6%. Consistent with this observation, determination of the genome-level average nucleotide identity with 14 other genomes from this species revealed that *Pseudomonas chlororaphis* strain 189 shares the highest genome sequence identity (98.36%) with this strain. Several other strains of *Pseudomonas chlororaphis* exhibiting biocontrol phenotypes, including PA23, have genome similarity metrics that place them in the same species as*Pseudomonas chlororaphis* strain 189. Like PA23, *Pseudomonas chlororaphis* strain 189 contains an array of biosynthetic pathways capable of producing metabolites involved in biocontrol, including hydrogen cyanide, phenazine, pyocin, pyrroloquinoline quinone, and cell wall degradative enzymes. Genes conferring the ability to produce surfactants and form biofilms were also found. The sequence data for this complete genome has been deposited at DDBJ/EMBL/GenBank under accession number CP014867 (Town et al., *Genome Announcements* (May/June 2016) 4(3): e00581-16).

*Pseudomonas fluorescens* Strain KENGFT3

Genomic DNA was purified from 1 mL of an overnight culture in YGM (Example 1) of *Pseudomonas fluorescens* strain KENGFT3 using a Wizard genomic DNA (gDNA) extraction kit (Promega, Madison, Wis., USA) and sequenced on the GS Junior using Titanium Plus chemistry (Roche Diagnostics, Laval, Quebec, Canada). Reads from two shotgun sequencing runs with average read lengths of 548 and 534 bp were assembled using Newbler version 3.0 (454 Life Sciences). The total number of filter-passed reads was 128,460, and the total number of bases assembled was 69,421,957. These reads were assembled into 97 large contigs, with an $N_{50}$ contig size of 131,172 kbp.

In addition, an 8-kb-insert paired-end sequencing run was performed based on the paired-end rapid library preparation protocol for Titanium chemistry (Roche), with modifications as described (Hill et al., Protocol Exchange (2014) doi: 10.1038/protex.2014.028). A total of 105,459 paired-end reads were generated, with an estimated pair distance of 6,361±1,590 bp. Assembly of all the sequencing runs together produced an improved high-quality draft sequence featuring 16× genome coverage of a single scaffold with 9 scaffold contigs (SEQ ID NO:4 to SEQ ID NO:12, Table 3). Sequence data were annotated using the Prokaryotic Genome Annotation Pipeline version 2.0 (NCBI).

TABLE 3

| Contig | Location in genome | Number of base pairs | Sequence |
|---|---|---|---|
| 1 | 1 to 1127585 | 1127585 | SEQ ID NO: 4 |
| 2 | 1132047 to 1134857 | 2811 | SEQ ID NO: 5 |
| 3 | 1135358 to 1187082 | 51725 | SEQ ID NO: 6 |
| 4 | 1187731 to 1902001 | 714271 | SEQ ID NO: 7 |
| 5 | 1902220 to 2952001 | 1048002 | SEQ ID NO: 8 |
| 6 | 2950759 to 4502624 | 1551866 | SEQ ID NO: 9 |
| 7 | 4502688 to 4522603 | 19916 | SEQ ID NO: 10 |
| 8 | 4522629 to 5334906 | 812278 | SEQ ID NO: 11 |
| 9 | 5335136 to 6183292 | 848157 | SEQ ID NO: 12 |

The genome of *Pseudomonas fluorescens* strain KENGFT3 contains 6,183,292 bp (59.95% G+C content). A total of 5,791 genes and 5,549 protein-coding genes were observed, along with 6 genes encoding 5S rRNA, 5 genes encoding 16S rRNA, 5 genes encoding 23S rRNA, and 64 tRNA-coding genes. The majority (77.76%) of protein-coding genes had a predicted function, and 2,053 COG clusters were identified.

The species identification tool SpecI (Mende et al., Nat Methods (2013), 10: 881-884) could not assign *Pseudomonas* sp. strain KENGFT3 to a species cluster (the average nucleotide identity was 95.1% to *Pseudomonas fluorescens* strain SBW25; GenBank accession no. NC_012660.1). JSpecies (Richter et al., Proc Natl Acad Sci USA (2009) 106: 19126-19131) also revealed that *Pseudomonas* sp. strain KENGFT3 had genome comparison metrics that placed it below the identified cutoff for inclusion in the same species as *Pseudomonas fluorescens* SBW25. However, *Pseudomonas fluorescens* strain LBUM223, which shares certain phenotypic attributes with strain KENGFT3, had genome comparison metrics that place these two strains within the same species (average nucleotide identity (ANI), 99.39%). Calculation of a phylogenetic distance tree using 60 strains of *Pseudomonas fluorescens* annotated at the Integrated Microbial Genomes portal revealed that *Pseudomonas fluorescens* strains KENGFT3 and LBUM223 clustered with *Pseudomonas fluorescens* strains GcM5-1A and UK4. *Pseudomonas fluorescens* strain KENGFT3 possesses an array of genes that have been associated with biocontrol phenotypes, including phenazine carboxylic acid synthesis, chitinases and cellulases, and pyrroloquinoline quinone biosynthesis, among others. Ten genes encoding putative β-lactamases were also found. The sequence data for this complete genome have been deposited at DDBJ/EMBL/GenBank under the accession no. CP014868 (Town et al., *Genome Announcements* (May/June 2016) 4(3): e00428-16).

*Pantoea* sp. strain OXWO6B1

Genomic DNA was purified from 1 mL of an overnight culture in YGM (Example 1) of *Pantoea* sp. strain OXWO6B1 using a Wizard genomic DNA (gDNA) extraction kit (Promega, Madison, Wis., USA). Genomic shotgun sequencing was performed on the MiSeq platform (Illumina), generating 2.9 M paired-end reads. These data were supplemented by an 8-kb-insert paired-end sequencing run using the paired-end rapid library preparation protocol for Titanium chemistry (Roche, March 2012), with modifications as described previously (Hill et al., Protocol Exchange (2014) doi:10.1038/protex.2014.028). This process generated 187,389 paired-end reads with an estimated pair distance of 6,310±1,577 bp.

Illumina reads were assembled using SOAPdenovo2 (version 2.01), with kmer size of 127 and map length of 34. The resulting 690 contigs ($N_{50}$, 44,093 bp) were split into 500-bp pieces with a 200-bp overlap using the EMBOSS splitter, combined with the Roche paired-end reads, and reassembled using Newbler (version 3.0). Gaps in the sequence were filled using the GapCloser tool for SOAPdenovo2, along with PCR and Sanger sequencing. Assembly of all the sequencing data together produced a high-quality draft genome sequence with 201× coverage featuring 2 scaffolds of 4,677,766 bp (2 scaffold contigs; the first containing residues 1 to 200112 (SEQ ID NO:13) and the second containing residues 200566 to 4677766 (SEQ ID NO:14)) and 118,792 bp (single contig; SEQ ID NO:15), respectively. Three plasmids of 253,747 bp (SEQ ID NO:16), 181,185 bp (SEQ ID NO:17), and 4650 bp (SEQ ID NO:18) were confirmed using PCR. Sequence data were annotated using the Prokaryotic Genome Annotation Pipeline version 3.1 (NCBI) and the Integrated Microbial Genomes portal.

The genome of *Pantoea* sp. strain OXWO6B1 is 5,236,140 bp (52.74% G+C content). A total of 5,030 genes and 4,868 protein-coding genes were identified, along with 10 genes encoding 5S rRNA, 7 genes encoding 16S rRNA, 7 genes encoding 23S rRNA, and 78 tRNA-coding genes.

The sequences of the taxonomic markers 16S rRNA and rpoB suggest that strain OXWO6B1 is most closely related to *Pantoea ananatis*, with 99% (16S) and >97% (rpoB) identity to *Pantoea ananatis*. However, the bacterial barcode marker cpn60 has a lower sequence identity with any *Pantoea* sp. (the nearest neighbor was *Pantoea stewartii*, with 93.7% sequence identity). Consistent with this, the genomic average nucleotide identity (ANI) of strain OXWO6B1 was below the specified cutoff for species identity with any reported species of *Pantoea*, with a maximum of 88.9% ANI with *Pantoea ananatis*. Moreover, a comparison of 40 Clusters of Orthologous Groups (COGs) using SpecI (Mende et al., Nat Methods (2013), 10: 881-884) revealed that *Pantoea* sp. strain OXWO6B1 could not be assigned to a species cluster (average nucleotide identity was 95.0% to *Pantoea ananatis*). *Pantoea* sp. strain OXWO6B1 contains genes that have been associated with biocontrol phenotypes, including phenazine carboxylic acid synthesis and cell wall-degradative enzymes. Two genes encoding putative beta-lactamases were also observed. This whole-genome shotgun project has been deposited at DDBJ/ENA/GenBank under the accession nos. LWLR00000000 and LWLR01000000 (Town et al., *Genome Announcements* (May/June 2016) 4(3): e00582-16).

*Arthrobacter* sp. strain OY3WO11

Genomic DNA was purified from 1 mL of an overnight culture in YGM (Example 1) of *Arthrobacter* sp. strain OY3WO11 using a Wizard genomic DNA (gDNA) extraction kit (Promega, Madison, Wis., USA) and sequenced on the GS Junior using Titanium Plus chemistry (Roche Diagnostics, Laval, Quebec, Canada). A total of 142,372 shotgun reads of 644-bp average length was generated. In addition, an 8-kb-insert paired-end sequencing run was performed based on the paired-end rapid library preparation protocol for Titanium chemistry (Roche, March 2012), with modifications as described previously (Hill et al., Protocol Exchange (2014) doi:10.1038/protex.2014.028). A total of 170,435 paired-end reads was generated, with an estimated pair distance of 6,383±1,595 bp. Assembly of all sequencing runs together produced an improved high-quality draft sequence, with 35× genome coverage. The data were assembled using Newbler version 3.0 (454 Life Sciences), generating 3 scaffolds of 4,253,622 bp (containing 19 contigs; SEQ ID NO:19 to SEQ ID NO:37, Table 4), 258,581 bp (1 contig; SEQ ID NO:38), and 4,841 bp (1 contig; SEQ ID NO:39), respectively. The sequence data were annotated using the Prokaryotic Genome Annotation Pipeline version 3.1 (NCBI).

TABLE 4

| Contig | Location in scaffold | Number of base pairs | Sequence |
|---|---|---|---|
| 1 | 1 to 20368 | 20368 | SEQ ID NO: 19 |
| 2 | 20493 to 46135 | 25643 | SEQ ID NO: 20 |
| 3 | 46208 to 66053 | 19846 | SEQ ID NO: 21 |
| 4 | 66079 to 256125 | 190047 | SEQ ID NO: 22 |
| 5 | 256156 to 582121 | 325966 | SEQ ID NO: 23 |
| 6 | 582147 to 998882 | 416736 | SEQ ID NO: 24 |
| 7 | 1003835 to 1191389 | 187555 | SEQ ID NO: 25 |
| 8 | 1191475 to 1272502 | 81028 | SEQ ID NO: 26 |
| 9 | 1272530 to 1482163 | 209634 | SEQ ID NO: 27 |
| 10 | 1482225 to 1573044 | 90820 | SEQ ID NO: 28 |
| 11 | 1573080 to 1697136 | 124057 | SEQ ID NO: 29 |
| 12 | 1698282 to 1776987 | 78706 | SEQ ID NO: 30 |
| 13 | 1777265 to 2007632 | 230368 | SEQ ID NO: 31 |
| 14 | 2007658 to 2156687 | 149030 | SEQ ID NO: 32 |
| 15 | 2156715 to 2486251 | 329537 | SEQ ID NO: 33 |
| 16 | 2486290 to 2527990 | 41701 | SEQ ID NO: 34 |
| 17 | 2528079 to 3060107 | 532029 | SEQ ID NO: 35 |
| 18 | 3060133 to 3413802 | 353670 | SEQ ID NO: 36 |
| 19 | 3413828 to 4253622 | 839795 | SEQ ID NO: 37 |

*Arthrobacter* sp. strain OY3WO11 has a total genome size of 4,517,044 bp, with a G+C content of 65.29%. Genome annotation reveals 4,225 genes and 4,163 protein-coding genes. The genome features 1 gene encoding 5S rRNA, 2 genes encoding 16S rRNA, 1 gene encoding 23S rRNA, and 50 tRNA-encoding genes.

The genome of *Arthrobacter* sp. strain OY3WO11 contains genes that have been associated with biocontrol phenotypes, including phenazine carboxylic acid synthesis and cell wall-degradative enzymes. Two genes encoding putative beta-lactamases were observed. The sequences of taxonomic markers, including the 16S rRNA-encoding gene and rpoB, share 97 to 99% identity with the corresponding genes found in *Arthrobacter phenanthrenivorans* Sphe3. Similarly, two copies of the bacterial barcode marker cpn60 were identified, each of which clustered with corresponding copies from *Arthrobacter phenanthrenivorans* Sphe3 by phylogenetic analysis and have sequence identities of 93 to 96%. Comparison of the genome sequence of *Arthrobacter* sp. strain OY3WO11 to 85 genomic sequences from *Arthrobacter* spp. annotated at the Integrated Microbial Genomes portal revealed that the average nucleotide identity (ANI) of the genome of strain OY3WO11 was below the specified cutoff for inclusion in any of the species included in the analysis (the closest ANI was *Arthrobacter phenanthrenivorans* Sphe3, at 85.25%). In addition, SpecI (Mende et al., Nat Methods (2013), 10: 881-884) could not assign strain OY3WO11 to a species cluster; the closest match was *Arthrobacter phenanthrenivorans* Sphe3, with an average ANI of 93.9% over 40 Clusters of Orthologous Groups (COGs). Taken together, these observations suggest that strain OY3WO11 may represent a previously uncharacterized or unsequenced strain of *Arthrobacter*. This whole-genome shotgun project has been deposited at DDBJ/ENA/GenBank under the accession nos. LWLP00000000 and LWLP01000000 (Town et al., *Genome Announcements* (May/June 2016) 4(3): e00585-16).

*Bacillus subtilis* Strain WAUSV36

Genomic DNA was purified from 1 mL of an overnight culture in YGM (Example 1) of *Bacillus subtilis* strain WAUSV36 using a Wizard genomic DNA (gDNA) extraction kit (Promega, Madison, Wis., USA) and sequenced on the GS Junior using the paired-end rapid library preparation protocol for Titanium chemistry (Roche, March 2012), with modifications as described previously (Hill et al., Protocol Exchange (2014) doi:10.1038/protex.2014.028). Reads from two paired-end sequencing runs (average read lengths of 418 and 419 bp) were assembled using Newbler version 3.0 (454 Life Sciences). The total number of filter-passed reads was 309,047. These reads were assembled into 2 scaffolds of 4,179,279 bp (19 contigs; SEQ ID NO:40 to SEQ ID NO:58, Table 5) and 59,592 bp (1 contig; SEQ ID NO:59), respectively. The $N_{50}$ contig size was 1,049,070 bp. Assembly of all sequencing data produced an improved high-quality draft sequence featuring 25× genome coverage. Sequence data were annotated using the Prokaryotic Genome Annotation Pipeline version 3.1 (NCBI).

TABLE 5

| Contig | Location in scaffold | Number of base pairs | Sequence |
|---|---|---|---|
| 1 | 1 to 55345 | 55345 | SEQ ID NO: 40 |
| 2 | 55436 to 58401 | 2966 | SEQ ID NO: 41 |
| 3 | 58427 to 59953 | 1527 | SEQ ID NO: 42 |
| 4 | 59979 to 75421 | 15443 | SEQ ID NO: 43 |
| 5 | 75447 to 78412 | 2966 | SEQ ID NO: 44 |
| 6 | 78829 to 80355 | 1527 | SEQ ID NO: 45 |
| 7 | 80474 to 1129543 | 1049070 | SEQ ID NO: 46 |
| 8 | 1130965 to 1133929 | 2965 | SEQ ID NO: 47 |
| 9 | 1134574 to 1341361 | 206788 | SEQ ID NO: 48 |
| 10 | 1341387 to 1487681 | 146295 | SEQ ID NO: 49 |
| 11 | 1487707 to 1537269 | 49563 | SEQ ID NO: 50 |
| 12 | 1537295 to 1915605 | 378311 | SEQ ID NO: 51 |
| 13 | 1915842 to 2014432 | 98591 | SEQ ID NO: 52 |
| 14 | 2014495 to 2177840 | 163346 | SEQ ID NO: 53 |
| 15 | 2177866 to 3402322 | 1224457 | SEQ ID NO: 54 |
| 16 | 3402456 to 3405421 | 2966 | SEQ ID NO: 55 |
| 17 | 3407164 to 3715576 | 308413 | SEQ ID NO: 56 |
| 18 | 3715749 to 3718714 | 2966 | SEQ ID NO: 57 |
| 19 | 3720140 to 4179279 | 459140 | SEQ ID NO: 58 |

The genome size of *Bacillus subtilis* strain WAUSV36 is 4,238,871 bp and is composed of 43.32% G+C content. A total of 4,510 genes and 4,404 protein-coding genes were observed, along with 2 genes encoding 5S rRNA, 3 genes encoding 16S rRNA, 5 genes encoding 23S rRNA, and 60 tRNA-encoding genes. A total of 1,688 Clusters of Orthologous Group (COG) clusters were identified by annotation using the Integrated Microbial Genomes (IMG) portal.

The sequences of taxonomic markers, such as the 16S rRNA-encoding gene and rpoB, are >99% identical to the corresponding sequences of many strains of *Bacillus subtilis*. Similarly, the single-copy bacterial barcode marker cpn60 is identical in sequence to several strains of *Bacillus subtilis*. At the whole-genome level, strain WAUSV36 has pairwise average nucleotide identities of 99.96% with 25 strains of *Bacillus subtilis* available at the IMG portal and is below the specified nucleotide identity cutoff for other species of *Bacillus*. Finally, SpecI (Mende et al., Nat Methods (2013), 10: 881-884) assigned strain WAUSV36 to the species cluster *Bacillus subtilis*, with an average of 98.93% identity over 40 COGs. These observations suggest that strain WAUSV36 is a strain of *Bacillus subtilis*.

Similar to other strains of *Bacillus subtilis* associated with biocontrol phenotypes, the genome of strain WAUSV36 featured genes involved in biofilm formation, but no genes associated with surfactin production were observed. Five genes encoding putative beta-lactamases and three cellulase genes were also found. This whole-genome shotgun project has been deposited at DDBJ/ENA/GenBank under the accession nos. LWLQ00000000 and LWLQ01000000 (Town et al., *Genome Announcements* (May/June 2016) 4(3): e00586-16).

Example 6

Determination of Antifungal Activity by Measuring Fungal Growth Using an Indirect Impedance Assay The method used for evaluating antifungal activities of bacterial isolates against *Phytophthora infestans* is similar to that described by He, J. et al. "Concurrent selection for microbial suppression of *Fusarium graminearum*, fusarium head blight and deoxynivalenol in wheat" *Journal of Applied Microbiology* (2009), 106(6), 1805-1817. Growth of *Phytophthora infestans* in liquid medium in the presence or absence of cell-free culture filtrates of the bacterial isolates to be tested is measured by a Microbiological Impedance Analyser (BacTrac™ 4300, Sy-Lab Instruments GmbH, Austria). Microbial growth is measured based on reduction of impedance of the medium caused by the production of small, charged compounds as microbial growth proceeds.

Cell-Free Bacterial Culture Filtrates:

Bacterial isolates (OY3WO11, 189, WAUSV36, KENGFT3, OXWO6B1 and UWO1) stored at −80° C. are suspended in potato dextrose broth (PDB (Difco™), Becton, Dickinson and Company) or minimal medium (M M, Shao, S., Zhou, T., and McGarvey, B. D. "Comparative metabolomic analysis of *Saccharomyces cerevisiae* during the degradation of patulin using gas chromatography-mass spectrometry.", *Applied Microbiology and Biotechnology*, (2012) 94(3), pp. 789-797), and adjusted to an optical density (OD) reading of 1.0 (620 μm). Medium (PDB or MM; 24 mL) in a 50 mL Falcon™ tube is inoculated with 1 mL of the bacterial suspension. The inoculated tubes are incubated at room temperature (23±2° C.) on a rotary shaker at 150 rpm for 6 days. The resulting bacterial cultures are centrifuged at 2,650 g for 10 min and the supernatants are filtered through a 0.22 μm syringe filter (mixed cellulose ester; MCE) into fresh tubes, to provide cell-free bacterial culture filtrates.

Assay Conditions:

For each experiment, five samples (discs 9 mm in diameter) cut from *Phytophthora infestans* cultures grown on Rye B agar (Caten, C. E. and J. L. Jinks. "Spontaneous variability of single isolates of *Phytophthora infestans*. I. Cultural variation." *Can. J. Bot.* (1968) 46: 329-348) for 2-3 weeks are each placed into a measuring tube of the Microbiological Impedance Analyser, followed by addition of 2 mL of cell-free bacterial culture filtrate. Sterile medium is used as a control. Fungal growth (measured by impedance changes) is monitored at 20 min intervals for 120 h at 22° C. Each experiment is replicated three times.

Data Analysis:

Curves of impedance changes are analyzed using the BacEval™ computer program (Sy-lab Instruments GmbH (2002): BacTrac™ 4000 Series Microbiological Operation Manual V1.05e). Data of impedance measurements is transformed inversely and used as indicator of fungal growth. The data are statistically analyzed using SAS/STAT™ 9.2 (SAS), general linear model (GLM) procedures. Fungal growth curves were compared using CONTRASTS (SAS); means of fungal growth at each time point are compared using Tukey's test.

Results

Statistical analysis for all 6 bacterial isolates indicated that growth curves of *Phytophthora infestans* in the two media used, MM and PDB, are significantly different (P<0.001), and were analysed separately.

Figure 6:
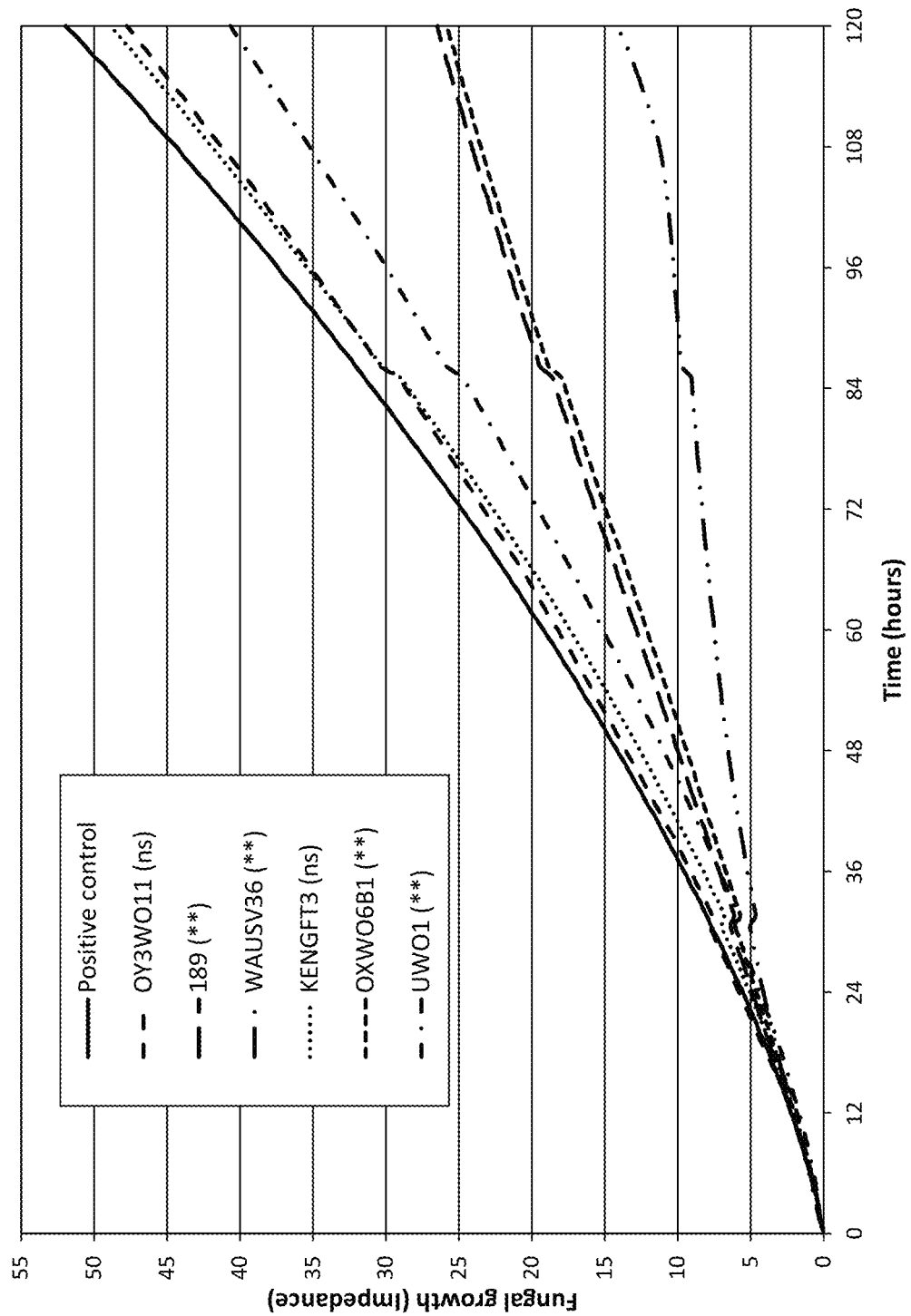
FIG. 6 is a graph showing the growth of *Phytophthora infestans* in minimal medium (MM) in the presence of cell-free bacterial culture filtrates or sterile medium (positive control), as determined by impedance measurements. "ns" indicates not significantly different from the control at the $p=0.05$ level; "**" indicates significantly different from the control at the $p=0.01$ level.

As seen in FIG. 6, growth of *Phytophthora infestans* was fastest in MM in the absence of cell-free bacterial culture filtrates (positive control). Among the 6 bacteria tested, cell-free filtrates from 4 bacterial strains (189, WAUSV36, OXWO6B1 and UWO1) showed significant inhibition of fungal growth (P<0.01). However, growth of *Phytophthora infestans* treated with cell-free filtrates from bacterial isolates OY3WO11 and KENGFT3 was not statistically significantly different from that of the control (P>0.05).

Figure 7:
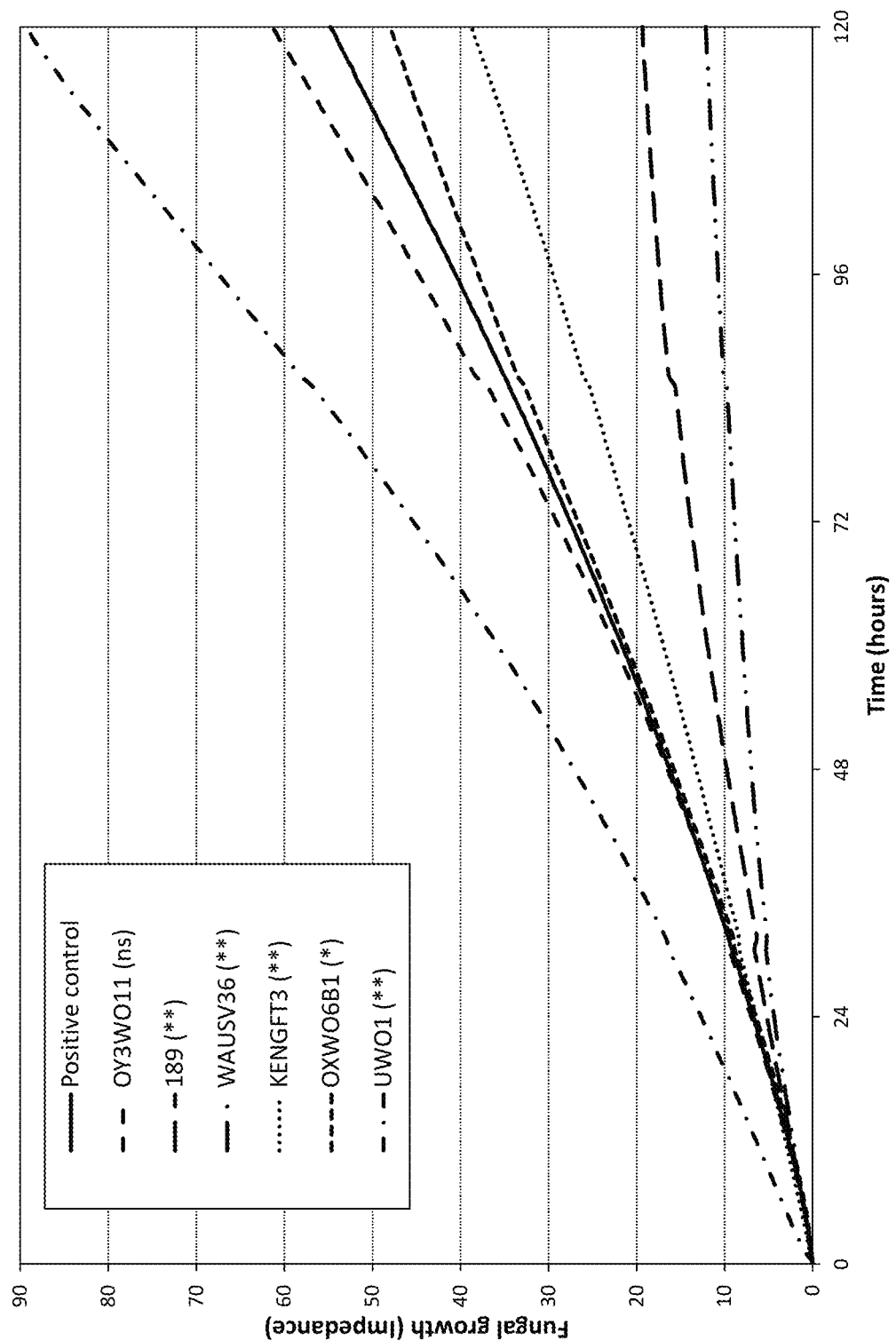
FIG. 7 is a graph showing the growth of *Phytophthora infestans* in potato dextrose broth (PDB) in the presence of cell-free bacterial culture filtrates or sterile medium (positive control), as determined by impedance measurements. "ns" indicates not significantly different from the control at the $p=0.05$ level; "*" indicates significantly different from the control at $p=0.05$ level and "**" indicates significantly different from the control at $p=0.01$ level.

As seen in FIG. 7, four cell-free bacterial culture filtrates (from strains 189, WAUSV36, OXWO6B1 and KENGFT3) inhibited growth of *Phytophthora infestans* in PDB. The cell-free filtrate from isolate OXWO6B1 showed statistically significant growth inhibition (p=0.05), and the cell-free filtrates from isolates WAUSV36, 189 and KENGFT3 showed even stronger growth inhibition (p=0.01). The cell-free filtrate from isolate OY3WO11 showed no significant effect on the growth of the pathogen, and the cell-free filtrate from isolate UWO1 significantly stimulated growth of *Phytophthora infestans* (p=0.01).

Figure 8:
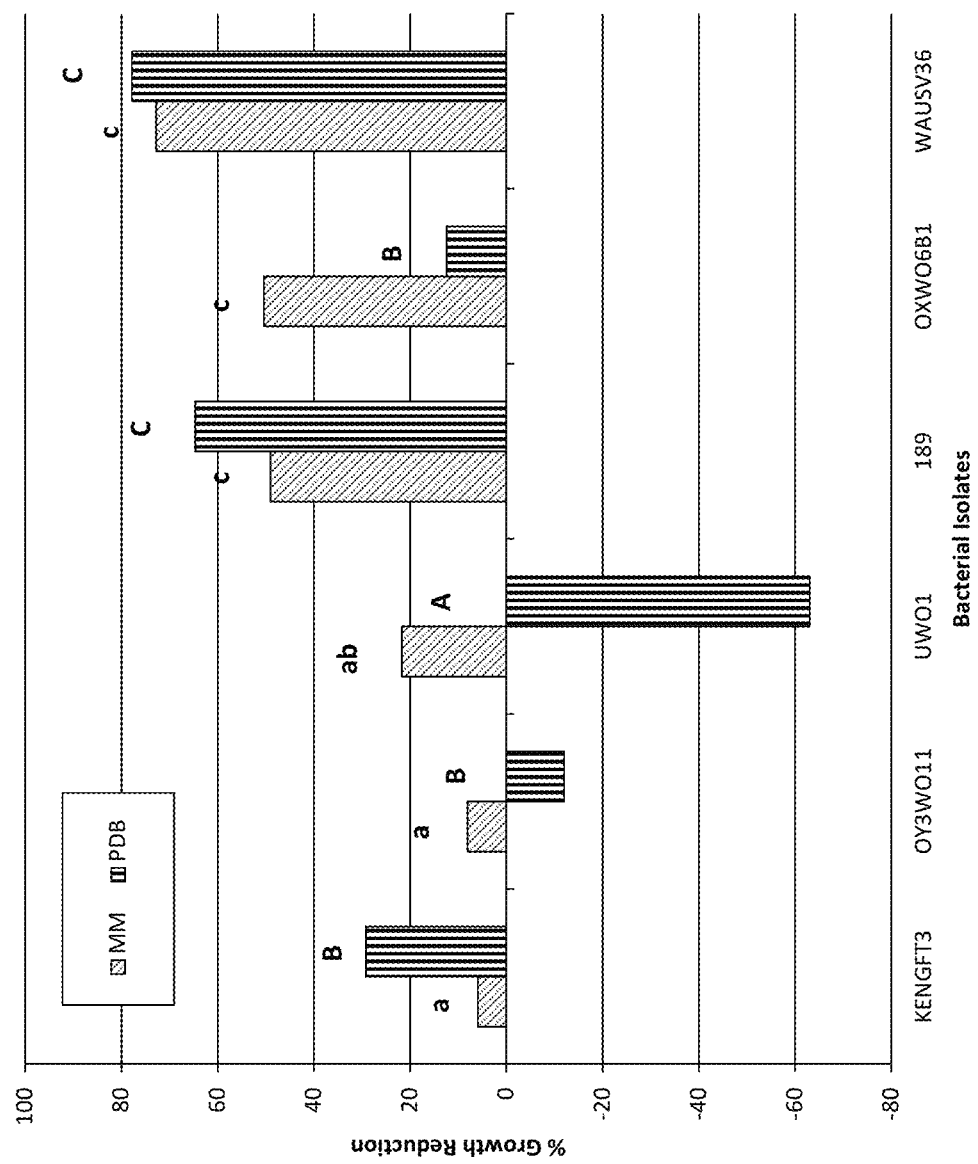
FIG. 8 is a bar graph showing percent growth reduction of *Phytophthora infestans* at 120 hours in the presence of cell-free bacterial culture filtrates compared with growth in the presence of sterile medium (positive control) as determined by impedance measurements. Means indicated with the same letter (A/a, B/b or C/c, for PDB and MM media, respectively) are not significantly different according to Tukey's test (Tukey, J. "Comparing Individual Means in the Analysis of Variance". *Biometrics* (1949) 5(2): 99-114) at the p=0.05 level.

FIG. 8 shows the percent growth inhibition of *Phytophthora infestans* after 120 hours incubation in the presence of cell-free bacterial culture filtrates compared to growth in the presence of sterile medium (positive control). Means indicated with the same letter (A/a, B/b or C/c, for PDB and MM media, respectively) are not significantly different according to Tukey's test (Tukey, J. "Comparing Individual Means in the Analysis of Variance". *Biometrics* (1949) 5 (2): 99-114) at the p=0.05 level. In MM, cell-free filtrates from isolates WAUSV36, OXWO6B1 and 189 significantly reduced the fungal growth as compared with the control, and inhibited *Phytophthora infestans* growth by 72.8%, 50.4% and 49.0%, respectively. The cell-free filtrate from isolate UWO1 showed significantly weaker activity in MM, reducing *Phytophthora infestans* growth by 21.7%. In PDB, cell-free filtrates from isolates WAUSV36 and 189 inhibited the growth of *Phytophthora infestans* by 77.8% and 64.7%, respectively, compared to the control, significantly more than the cell-free filtrate from isolate KENGFT3, which reduced fungal growth by 29.2% in PDB.

The embodiments described herein are intended to be illustrative of the present compositions and methods and are not intended to limit the scope of the present invention. Various modifications and changes consistent with the description as a whole and which are readily apparent to the person of skill in the art are intended to be included. The appended claims should not be limited by the specific embodiments set forth in the examples, but should be given the broadest interpretation consistent with the description as a whole.

SEQUENCE LISTING (59 sequences)

SEQ ID NO: 1 - DNA, 50 bp, Artificial Sequence
  Primer H1594
cgccagggttttcccagtcacgacgacgtcgccggtgacggcaccaccac

SEQ ID NO: 2 - DNA, 50 bp, Artificial Sequence
  Primer H1595
agcggataacaatttcacacaggacgacggtcgccgaagcccggggcctt

SEQ ID NO: 3 - DNA, 6837781 bp, Pseudomonas chlororaphis 189 (residues 1-1,709,446 of 6,837,781)
cgctgccgtcgtgggccggcgccaggtgcagggtcgcgccgacacacagcgccgaccagacctcccaggccatggcgtcgaaaccgaaaccggccaggctcgaggtatgccggccctggcacaggtcgaaggctgtgcagtgccagtccaccaggttgcccaggctgcggtgctcgaccatcacccccttgggcaggccggtggagccggaggtgtagatcacatacgccaggtgcgccggggtcagcccggacacctgcgggttggtctcgggctgcgcctgccagtcgaaggcatcgaggtcgatcagcggcacgtccagggccggcaggcgtgccagcagctcgccctggctcagcaccgccagcggcgcgctgtcttccagcaggtaacgcaggcgttcggcgggatgggccgggtccaccggcacataggcgccgccggccttgaggatcgccagcagaccgaccagggtatcgaggccacggcgcgcgacgatcgccacccgctcgtccgggccgacgcccagcgcgctcaggtgatgggccagggcattggcccgctggttcagttcggcgtaggtcagcgactgccccaggcacactgcggccaacgcctggggcgtcgccgcggcctgggcttcgatgcgccggtggatagtctgcgccggagggaaactcacccggctgtcattgaagccgtgcagcagttgctcgcgttcggccggggccaggatcgacagctggtccagcgcctgctgcggggtctgctccagggcctgaaccagatgctccagggcagtgtgcatataaccgcagagacgcgcgccatcgacctcggcgctggccagcagggtcaggttgaagcctgcgccgaggtcgtcgacgctcagggtcagcgggtagttgctgcgctcctgggagccgaggttgctgatgccctgccaggccgcgctcggttcggcgctgctgggcgcggcgctgtgccgatagttgagcaaggcactgaacaatggcgtcggcgcgagcacgccgctgcaccgctgcgccagggccaggggcgcgtgttcatggcgcagcaaggtggtcagccgggcatgggtggccttgaccccggccagcaccggctggctgcccacatccacccgcagcggcaaggtattgatgaacatgcccagggcccggtcgttgtccccaccgccctgcatgcggcccatcagcaccgtgccgaacaccacctgccgcttgcccgacagcgcgcccagcacctgggcccaggccagatggaacaggcaggcggcgctcacccccgcctgccgcgcctgcaagcgcaggcgctggctcaggccgggcccgatgcccaggccggactcttcgctggcggcgccatcgccctgcacatcctgcaagccgaacggcagggtcggctcgtcgatatcgccgagcatctcgcgaaagaacgcttcatgctcctgttcgctgatgcccaagcgtgcctgggccacatagttgcgaaacggcaccgccggccccaggccctgcgcctggtccagcaggaaggcctgcaattcgtggcggaccacgtccagggcgctgtggtccatggccatatggtggaacagcaggctggcgaccaggcactgcccggcttcgtcgcgggcgtataccaggcgcagcagcggcgcctgggtcacgtccaggcggtaatgccgggggtcgaagcgcgcccgcaactgctcggcgaccgggccgtccgccggatcgagcgcgacgtcctccaactccagggtggcctggcgccagaccacctgcaccggttcttccagcccttgccaatgcaccgcggtgcgcaggatgtcgtgccggtcgatcaccccctgcaaggcctcggcaaaggccgccaggcgctccgcgctggcgaaggcgaactgcgcctgcagcacataggggtcgccctgggtggcgctggcgtggtggtagaggatgccttgctgcaagggcgccagcggatagatgtcctgcacattggccacgccgccgggcaccgtggcgacgatccgctcgatcgcctcctggctcaggctggccaggggcagcatggccggggtgatatgccgggcatcggcgccgatcaggttggccggcaccgcgacccgcccggccgtgctggcgtcatagtgcccgctacggatcagctcgatcagcgccggcttgtgttcgcgcagcagggccagggtcgccggttcgctcagcgcctgcttgttgccttgcaccagcagctgatcacccttgagcgccagttgaatatccttggccttcagtgtcgccagtacttcgatcatgctcacaggacgatctccattcgttcggtcattgccgcgtagcccgccagggtcggctgttcgaacagcgccctgacatcggcttccatgccttcctggcgcagccgaccaatcaggctgacggccagcagcgaatgcccgcccagctcgaagaaatggtcgtgccgccctacccgttccacgttcagcaactcggcccagatccgcgccaggaggatttcggtgtcgccttgcggtgcttcgtactcgcgcacccgcagcgactccaagtccggggccggcaaggctttgcgatcgagcttgccattggggctcaggggcaaggccggcaggtgcacgaacagcgccggcaccatgtactccggcagttgctccagcaagtggctgcgcagtgcctcggtttcgaggcgttcgctggaaagctcggtggtgtaataagccaccaggcgcttgtcccccggcacgtcttcccgggccaggaccaccgcctctttcacacccaagaactgggtcaaccgcgcctggatttctcccagttcgatacgcaggccgcggatcttcacttggtcgtcgttgcgccccaggtactcgatggtgccgtccgccagataccggccaaggtcgccggtgcgatacatgcgggcctgggggccgccgttaacagaatcggcgctgaacgggtccttgaggaaacgctcggcggtcagctccgggcgatgcagataaccgcgcgccacctgcaccccgccgatatacagctcgcccaccacccccaaaggcaccggttgcaactgttcatccagcaggtacaggcgggtgtcggcgatgggtttgccgatcggcgtattgtccgggacctgctccacaggccccgcacagtgccaggcggtcacgtccaccgcggcctcggtcgggccgtagaggttgtgcaattggctgcccggtagttgcgccttgaagcgtcgtaccaggctgcccggcagcgcctcgccgctgcacagcacgcgcagcagtccagtgcagcgagcggtatcgccatgggcgaggaacacatcgagcatcgacggtacgaagtgcacggtggtgatgcgttcggcctggatcacgtcgcacaggtaggccgggtctttatggccttccggacgagccatcaccagccgcgcgccggtcatcagcggccagaagagttcccagaccgacacatcgaaactgaacggcgttttttgcagcaccgtatcctcggcgcagaggccatattggtcctgcatccacaacaggcgattgaccacggcgcggtgttcattgatcacacccttgggtttaccagtgggacccgaggtgtagatcacatagaccagatgccgtggagtcagctcggcgatgactggattgtcgagcggctggtccagccagaccggtcgatccagatcgattaccggcgcatcccccaacagctcccgggtcgcgccttgagccaagaccactaccggcgcgctgtcttccagcatgtaggcgatccgctccaacggatacgccgggtccagcggtacataaccgccgccggccttgaggatcgccagcaaacccaccaccatctccagcccgcgctcgacacagatcgccacccgcgagtccggccccaccccctgctgacacagataatgcgccagctggttggcccgctcattcaggacgcggtacgtcagtgattgctcgccggccttgaccgccagcgcctcgggcgtgcgctcgacctgggcctcgaacagcccatgaatgctctgctcaaggtcgtaaggcacctcggtatcgttgaacgccactagcagttgccggcgttcctcggcggtgatcaccggcaggcggttcagggcggtttgcggcgactgttccagggcgtccaccagcccctgcagcgcggtctgcataaagtcgcaaacccgctgcgcgcccactccggcggcaaccagcgcggtgagctggtagccatcgcccaggtcgtcgacattgagggtcagcggatagttggtgcgctcttcgctggccagggtttcgatcccctgccaggcgtgttgcagcgccgggtgcggggtaacgctgtggcggtagttgagcatggcgctgaacagcggcgcgccggcggcgacgccactgcaacgttgcgccagggccagggacgcgtgttcgtggcccagcaacgccgtcaaccgggcatgggtggcgcgcacgccggcacgcacatcctgcccgtcgatatcgacccgcaacggcagggtattgataaacacccccagcgcccggtcggcgccgacgccgccctgcatcctgcctaccagcacggtgccgaacaccacgccgcgcttgcccgaagccgccgccagcacctgggcccaggccaggtggaacaggctggcggcgcttacccccagttgccgcgcctggcttctcaggcgctggttgagggacgccggcaggcacagctgccgttcctcgaccccgtgcccatcgccctgcacatcctgcaagccgaaggccagggtcggctcgtcgatatcgccgagcatctcgcggaagaacgcttcatgttcccgctcgccggtgcccaggcgcgcctgggccacatagttgcgaaacggcaccgccggccccagctgccgggcctggcccaacagcaaggcctggagttcgtggcgcaccacttccagggcgctgtggtccatggccaggtggtggaacagcaacaccgccaccacgcgctggcgcgccgggtcggcggcgtacatcagctggaccagtggcgcctgggtcagctccaggcggtaacgccgggcatcgaaacgctggagcaactgggccaacacctcgccggcggccgtgtcgcaggccacctcgcgcaccaccagcgacgcctcgcgccagaccacttgcaccggctgtttcaggccctcccagagcacagtggtgcgcaggatgtcgtggcgctcgatcacctgccgcaaggcgccggcgaaggcctgcagacgctccaggctgtcgaaggccatgcgcgattgcagcaggtagggatcgccctgctctgctatgaggtggtgatacaggatgccctcctgcaacggcgacagcgggtagatgtcctgcacattggccgcgccgccggggacctgggcgacgatccgctcgatctcggcctgctgcagttccaccaacggcaacaggtccggggtgatgtgccggcagcccgcgggaatcaggttggccggcacctcgacctcgcgaccgctgccgaccgccgcggccagcgccgccagggtcggctggctgaacaggatgcgcacatcggcgccgaggcccagctggcgcatgcgctcgatcaggctcaccgccagcagcgaatgcccgcccagctcgaagaagtgatcgtggcggccgacccgctcgacctggagcacttcggcccagattccggccagggtcgcttcgacctcgccctggggcgcctcgtacccgcggctgagcaaggccgcctggtccggctccggcagcgccttgcggtcgagcttgccgttggcggtcagcggcaggctgtccaggcgtatataggccgcgggcagcatgtactcgggcagacacccttgcaggtgcgtgcgcagctgctcgatatccaccggtcgatgttcgctgaaccaggccagcaggcgtccgtcgcgcaccagcaccacgcattcgcgcagcgcctcgtgacgggccagggcggcttcgatttcccccagctcgatgcgcatgccgcgcaccttgacctgatcgtcgttgcgccccaggtactcgatggtgccgtcggccagccagcgcgccaggtcgccagtacggtacatccgtgctgcggggccgccgttcaccgaatcggcgctgaacgggtcgtcgaggaaccgctcggcgctcagttgcgcccggttcaggtaaccccgggccacgccggcgccgcccacgtacagctcgcccgccacgccgaccggcaccggttgcagttgctcgtccagcaggtagatgcgcgcattggccatgggcttgccgatatgcagcggccggccggcttcgatccttcccgaggtggcgaccaccgtggcctcggtcgggccgtagttgttgatcacctcaaagcgctggttgcggctgaagtggcgcaagcggtcgccaccgatcagcagcgtgcgcagggtcggatgttccaggtcgtggctgaaggcgtactcggccaccggggtcggcaggaagctgacgtccagcggttgtgcgcgccaccagtcgagcagttcgtcgatgtgttcgttaccgacctcgtccggcggcaggtgcagggtcgcgccgccgcacagggccggccagacttcccaggccatggcgtcgaaaccgcagccggcgacgctggaggcgtggctgccgggcttcagatcgaaggccgcgcagtgccagtgcaccaggttttccaggctgtggtgttcgaccatcacgcccttgggcaagccggtggagccggaggtgtagatcacataggccaggtgcgccgcggtcagcgccgggcagggattggtcaccgggcggtattgccagtcggtggccgccaggtcgatcagcggcaggctgtcgcccagcaagccacgagtctgctgttgcgccagcaccgccaccggcgcgctgtcctgcaacaggtaggcgatgcgttccgccgggtaggccgggtcgatcggcacataaccggccccggccttgagaatcgccaacagcccgatcagcatctgcgggccgcggcgcacgcagatcgccacccggtcgtccggctgcacgccctgggccagcaggtgccaggccagctggttggcgtgctggttgagctggcgataggtcaggcgctgctcgccctgcagcagcgcgaaggcgtccggggtgcgtgcggcccgggcttcgaacaggccgtggacggtctgcccgcgcgggtaatccgcggcgctggcgttgaagctcgacagcaggcgctgccgctccgcctgcggcaggatcggcaggtgttgcaacgccagttcggggtcctgctccagggcctgggccaactgctccagcgcctggcgcatgtactggccgatgcgctgcgcgccgatgctcgccagcgtcagcacatgcaggccgaagccctcgcccaggtcgtcgacgctcaaggtcagcgggtagttgctgcgctcttcgccgccgagcagttcgacgccctgccagatgccctggccggactgcgccatatcctgcggcgcgctgtggcgatagttgagcaaggcgctgaacagcggcgcgccggcggccacgccactgcaacgctgggccagggccagggaggcatgttcgtgccccagcagcgcggtcagccgggcgtgggtggccttgaccgcggcctgtacccccaggccgcgatcgacccgcagcggcaaggtgttgatgaacataccgagggcgcggtcggcgccctcgccgccctgcatgcggcccatcagcacggtggcgaacaccacgtcccgacggttcgacacctggcccagcacctgggcccaggccaggtgcatcaggctcgccgcgctcccccccaggcgccgggccagggcccgcaggcgcaggctcagggcggcgtccagggccagctcggcctcttcgatatcacggccgtcgccctgcacatcctgcaagccgaacggcagggtcggctcgtcgatatcgccgagcatctcgcggaagaacgcctcgtgctcccgctccgccgcccccaggcgcgcctgggccacgtagttgcgataaggcactggcatgcccaggcgctcggcttcgccgaacatgaaggcacgcatctcctcgccgaccacggccatcgccgtatggtccagggccaggtgatggaacagcaggatcgccaccagccggcgattgtccgggtcctcggcatagaccatgcgcagcagcggcgcctgggtcaggtcgaggcggtaatgacgggcatcgaagcaagcgtgcaactgctccagtacatcgccgccggcttccagcggcacctgttgcagcaccagctcggtcttgcgccacaccacctgcaccggttgtttcaagccctcccagagcaccgcggtccgcaggatgtcgtggcgttcgatgacctgttgcaaggcaccggcaaaggcctgcaaacgctccaggctgtcgaaggccatgcgcgattgcagcaggtaggggtcgccctgcccggcgctcaggtggtgatagagaatgccctcttgcagcggcgccagcgggtagatgtcctgcacattggccgcgccgccggggacctgggcgacgatacggtcgatctcggcctgctccagttccagcaacggcaacaggtccggggtgatgcgctggcagcccgcgccaatgcggttggccggcacctggatttcccggccgctgcccaccgccgcggccagggccgccaggcttggctggctgaacagggcgcgcacatcggcgctcaggccgatctggcgcatgcgctcgatcaggctcaccgccagcagtgaatgcccgcccagctcgaagaaatgatcgtagcggccgacctgctcgaccttgagcagctcgccccagatccgcgccagggcgatttccacctccccctgcggcgcctcgaaaccacggctgagcaaggcctcgcgctccggtgccggcagggccttgcggtccagcttgccgttggcggtcagcggcaggcggtcgaggcggacataggccgacggcaccatgtaatcggggagctggccttgcagctgggcgcgcaggcgctcgagcggcggcgccggcgcatcgttcgcggtggtgaagtaagccaccaggcgcttgtcgccgggctcgtcctcgcgggccagcaccaccgcgtcctggacgcccgggcaggccgccagccgggtctcgatttcgcccagctcgatacgcaagccgcgtagcttcacctgctgatcgttgcggccccggtacagcaaggtgccgtcggcgcgccaggacgccaggtcgccggtgcggtacagcagcgcctgcgcctcatccgcgaaaggatcggcaataaacgcctgggcagtcagttgcggctggttcaggtaacccttggccaccccggcgccgccgatatacagctcgcccaccgcgccgatcggcagcgggcgttgccgggcatcgagcacataggcccggctgttgccgatcggccggccgatggggatatcgccctcgcccaccgccccgtcatccaagccgatttcgaaggtggtggaaaaggtcgtggcctcggtcgggccataaccgttgagcaggtgccgcggcgcaccctgttgcaggacccggccgatcaccgccgggtcgagcacgtcgccgccgacgatcaggtaacgcaagcggctgaacgccgtcatcaggccatcggcgtactggtggaacaacccggcggtcagccacaacacgctgacctgttgctcctgcaacagctggccgaaggcctcgcgggacagcagcacgtcctgctcgaccagcaccacgcagccgccgttgagcaagggcgcccagacctccagggtgctggcgtcgaacgccgggttcgaggcaaaggccacccggtcgtcgcggttgaaatcggcatagccattgttgatcaccagccgcgtgatcgcccggtgcggcaccagcacgcccttgggcgtaccggtggaaccggaggtgtacatgatgtacgccacggcctcggaggactgcgccagcgccgggtcgtgctccggcaagccgtcaagggtcaggcagtccagatcgacccgcgccacgcggtgggaagacgcctggcgactgtcgctgagcagcagccgcgcggcgctgtcttcgagcatgaacgcctggcgcccggccggcgcattgatatccagcggcacatagaccgccgcgcacttgctcaccgccagctggctggccagcaggtccaggcagcgctccaggaggatcgccacgctgtcccccggctggaccccgaggccgatcaggtggtgcgccagctggttggcgcggcggttcaaggcgtcgtagctcaggccttgcccgccctgcaccgccgccgtggcctgcggatgctgccgcgcctgggcctcgaacagcgcatgcagggtctgggtgtggggatagtcgcgccgggtggcgttgaaggtcagcagcaggcgctggcgttcttccgccggcaggatgcccagctcgcgcaacggccgggccggcgcctgctccagggcctccaccaggcccagcaaggcgctttgcatgtaaccggcgacccgctggccaccgacctcggccagggtctgcaccaccagctcgaaggcttcgccatggtcgtcgacgttgagcaccagcgggtagttgctgcgctcttgcgagctgagaatctggatgccgtcccaggccgcgccgtccaccgcggccattgcttcggcagcgctgtggcggtaattgagcaggctgctgaacagcggcagcgacgccggcacgctgctgcaacgctgggccagggacaaggatgcgtgttcatgcccgagcaactgcgagagccggccgtgggtggcgcgcagcgcgtcgcgcacgcccacggcgccgaggctgacccgcagcggcaaggtattgataaacatgcccagggcgcggtcggcgccctcgccgccctgcatccgccccagcagcacggtgccgaacaccacgtcttcgcggccggacacctggcccagcacctgggcccaggccaggtgcaccaggctggcggcgctgaccccgagctggcgcgcctgttggcgcaggcgccgagccaaggctgcgtccagcggcaagcgcgcctcttcgacaccgctgccgtcacggttgacgtcccccaggccgaaggccagggtcggctcgtcgatgtcgccgagcatctcgcggaagaaggcttcgtgctcttcctcgctgaccccgagccgggcctgggccacgtagttgcggtactgcacggcttcgcccaaaggctgggcctgaacggctgcatccagggagcgggcaagcccgctgaggctggcgctcatttccgccaccagcccggccagcgccgtgtggtccaggaggatatggtgcaacagcaagatgcccagccagcgctggttggcctcgtcgcgggagtaggcaaagcgcatcagcgcggcgcggttcaggtccagccggtaatgccgcgggtcgaagcgttgctgcaagtgccgcagcacatcgccgtccgcggtttcgccggccacctgctccacactcagcggcgcctggcgccagaccacctgcaccggctcgtcgaggccctgccaatgcacgctgctgcgcaggatgtcatggcgctcgatcacgctgttcagcgcgccgataaaggcctcgacccgcgacaggtcgctgaagccgcactgcacctgcagcacataggggtcgccctcggcgctggccaggtggtgatagagaatgcccgcctgcaacggcgccaggccgtagatgtcctgcacattggcaacgccgccggggatctcggcgacgatgcgctcgatggccgcctggtcgagatccgccagcggcagcaggtccggggtgatatgggtgcaatcggcgccaatgcggttggccggcaccgctaccgagtgctggccgtcgaccgcggcggccagcgcggccagggtcggctggccgaacagcacccgcacatcggcgcccagttccagctggcgcatgcgctcgatcagtttgaccgccaacagcgaatgcccacccaactcgaagaagttgtcgtgacggccgacccgctcgaccttgagcagctcctgccagatcgccgcgatgcgctgttccacctcgccctgcggcgcctcgaaaccacgccgggccagggccgtgctgtccggcgccggcagcgccttgcgatccagcttgccgttggcggtcagcggcaaggcgtcgagctggacaaaggcgctcggcaccatgtactcggccagggacagcagcaactgctcgcgcagcgccgccgcttgcagctcgacgccttcggcgccgaccaggtaggccaccaggcgcttatcgccgggctcgtcctcgcgggcgatcaccaccgcctcgcgcacgccggcgcaggccgccagccgcgcctcgatttcccccagctcgatgcgaaagccgcggaccttcacctgatcgtcgttgcgccccaggtactccagctcgccctgggcgttccagcgcgccaggtcgccggtcttgtacaggcgctgcccgctgtccacacgaaacggatcgtcaatgaaacgctcggcggtcaacgcctcgcggttcaggtaaccgcgcgccaccccggcgccgccgacatacagctcgcccaccacccccacgggcaccggctcgcgccgcgcatccagcacgtacagttgcaggtcgggaatcgccccgccgatcggactggcccccaggcgccgggcatccgccgcctgcagggcgcggtaggtcacgtgcaccgtggtttcggtgatgccgtacatgttcaccagctgtgtgccggcgttttccacccgggcataccagggcttgaggatcgccgtttccagggcttcgccaccgaagatcacctggcgcagcgagtgcttgagcgggctgcgctcctgggccgcgatcaactggcggaaagcgctcggggtctggttgaggatgctcaccgaagcttcgcacagcagtgcatagcagtcgtccggcgagcggctgaccagttgcggcaccaccagcaaccggccgccgtggatcagcgcaccccagatttcccagaccgagaagtcgaaggcgaaggaatggaacagtgcccacacgtcctggcggttgaaggcgaacccgtcctgggtcgccgcgaacagccgcgccacgttgcggtgctcgatcatcacgcccttgggcacgccggtggagcccgaggtgtagatcacataggccaggttcgaactgctcagccccggcacctgggggttgtccgagggctgcttattcaactctggatcgtcgaggtcgagcagcggcaccgccagttcgcccagcaactgccgggtgccggcctgggccagcacggccagcggttcgctgtcgcgcagggtgtaggcgatgcgctgctggggataggccgggtcgatcggcacataaccggcgcccgccttgaggatgcccagcaggccgacgatcatttccaggccgcgctcgacacagatcgccacccggtcgtccgggcgcacgcccagggccagcaggcggtgcgccagccggttggcgcggcggttcagctcgccgtaagtcaattcccgcccttcatggatcagcgccgtggcgtcgggctgggccgcggcctgggcctccacctgctggtggatcaaggcactgtcggcgaattgccgcaccggattgaggccgtacagcagctgctggcgttcggccgccggcaggatatccaggccgtgcagcggcgcttgcgggctgtgctccagggccgcgaccaggctttccagggccgtttgcaggtaaccgcccaggcgctcggcaccgatctcggcggcgaccatcagggtcaggcgcaaaccctcacccaggtcgtcgacgttgaccgtcagcgggtagttggtgcgttcctcggcgcccagcacctggatgccgtcggcgatgtcgatcaccgccgccgcgtcgccggcggcgctgtgccggtagttgagcatggcgctgaacaacggcgtcggcgcgctcaccgcgctgcaacgctgggccagggccagcgaggcctgttcgtggtcaagcagcgcggtcaggcgctggtgggtggcctgcaccccggcgcgcacgctttgcccgtcgacatccacccgcagcggcaaggtattgataaacatgcccagggcgcgctcggcccctgcgccggcgtccatccttcccagcagcacggtgccgaacaccaccgcgctgcgtcccgaaaccttgcccaggaccagggccagcgccaggtgcatcaggctcgcggaactcacccccaactgccgcgactggccgcgcaggcgcaggctcagggcgtggtcgagatcgatgcgcagttcttcgatgccacggccgtcgccctgcacatcccgcaggccgaacggcagggtcggctcgtcgatatcgccgagcatctggcggaagaacgcctcgtgcgcctgctcgtccgcccccagccgcgcctgggccaggtagtcgcgaaacggcaccgccggcgccacctgcgcggtctggccgagcaggtgcgcctggatttccccgcgcaccaggtccagcgcggtgtggtccatgaccgtgtgatgaaacagcaacatcccgaccacccgctgctggtgcgggtcgtcggcgaagaccaggcgcagcagcggcgcctggcgcaggtcgaggcggtagtggcgggcatcgaagcgcgccagcaattgcgccagcacatcgccaccggccgcgaagctcacttcttcgcaaaccagccgggcctggcgccagaccacctgcaccggctcgtccagacgctcccagaacagcgcggtgcgcaggatgtcatggcgttcgatcacccattgcagggcctcggcgaaggcttgcaggcgctcgcggctggcgaaggcgaactgcgcgtgcagcacataggggtcgccctgctgcgccgacaggtggtggtagagcatgccttcctgcaggggcgccagcgggtagatgtcctgcacgttggccgcgccgcccggcacgctggcgacgatgcgctcgatggccggctggtcgagcctgaccagcggcagcatgtccggggtgatgcggtaggccgggctcagccagtcgccgtcatggcgggccaccagttccagcaggcgcgacttgtgcctgaccagactgtcccacagcgcgtcgtccagcccctcatcgtcacccagcacgaccaggtcgccttcttcctgttggagacggatcggctgggtggaaataattgccatcaattcgctgaactgcatgtaagtgacctgctttcaaattcgcaaacggttgatgagaaagtccggtttcggcggcaacccgatgcccgcacgacggccagccacgtccagcggccggcgcccggcccaagccaggctccagcgctgtggcggctccgccggcatgttcaagaaatgacaggggcggcgagcccgacggcgctgtcccgcaggcctggaaagctaaaacatccgtccggggctgtctgacacgggaagccgggacaaggcccgaggccgcggccctgggcctcgcgcaagcaacagcggcggccctcgggccgccgcgttctggtgtgaggaaatgttttgccgtcagagacggcgcttgcgattgagggtcgggatggtggtcgccggaatggccagccgctgcacatggcccacggttttggccgccagctccgccagggtcggctggctgaacagcacccgggcgtcggcatcgaggccggcctggcgcatgcgcgccaccaggctgaccgccagcagcgaatgcccgccgagctcgaagaagtggtcatggcgccccacccgctcgatcttcagcacctcggcccagatctgcgccagcaccgtttccacctcgccctggggcgcctcgaagccacggctgagcaccgcgtcctgtccaggcgccggcagggccttgcggtccagcttgccgttggggctcagcggcagggaatcgagctggacaaaggccgagggcaccatgtactccggcacctgggccaacagatgcccgcgcaagccttcgatgcccggcgccgtctcggcgtcgcgcaaggtgaaataggccaccaggcgctcgtcgcgcatcagcaccaccacttcgcgcagcgccgaatggctggccaggcgcgcctcgatctcccccaactcgacccgcaggccgcgcagcttgacctggaagtcgttgcgcccgaggaactccaggcagccgtcggcgcggtagcgcaccaggtcgccgctgcgatacaggcggtcgccagcaacgaacgggctgtcgataaaccgctcggcctgctgctgcgccagccccaggtaaccccgggccacccccaccccgccgatatgcaggtgcccgctgacgcccatgggcaccggccggtcgtgctcgtccaggacgtagagccgggtgttgccgatgggccgcccaatcggcagctggatgtccggcaccggcgccccgggttcgagggtccaggcggtgctgtccaccgtggcttcggtggggccatagacgttgtgcagccgtgcctgtggcagcagctgctggaagcgccgggccatggccgcggtgagttcgccgccaccgctgaacacgtcggtcaggctgctgcactggctgacctcgtcgagctcgaggaactgctggagcagcgccgggacgaacttgatcacggtgatgccctgctcgcggatggtctgcgccaggtaggccggctcgcggtgcccgtcgggccgcgccagcaccaggcgcatgccattggtcaaaggccagaacagctcccagaccgaaccgtcgaagctgaatggcgcgcgctgcaacaacgccccgtgctgtgcgttcgggcagatctgcgagccccagtgcatcaggttgccgaggccgcggtgctcgatcatcacgcccttgggcaggccggtggagccggaggtgtaaatcacataggccaggtgcccgacgttgagcccgggcacctgcgggtcgtccgcgggttgctgctgccagtcgcagcggtcgaagtcgatcagctcggccggcgatccggccagcagctcgcgggtcgcgccctgcaccagcaccgccagcggcgcgctgtcttgcagcatgtagtgcaggcgctcctgcgggtaacccgggtccagcggcacataggcgccgccggccttgagaatcgccagcaggccgatcaccagttccaggctgcgctcgacgcagatgccgacccgggtatcgggccgcacgccgcgctcacgcaagtgatgggccagctgattggcgcgccggttgagctgggcatagctcaactgccggtcgccggcctgcacggcgatggcgtccggggtgcggcgcacctgcgcctcgaacagcccgtgcagggtctgctcgcgggggtaatcgacctcggtggcgttgagttccaccagcagttggtgcagttgggccggcggcaataccggcagctggcgcagcgcagtccgtggcgcttgctccagggcctgcgccaggccgtcgagcacggtttgcagggcgtccagcaggcgctgtggctccaggctgcggggcgccatggcgctcagcttgaaaccctcgtccaggtcgtccaccgacagcatcagcgggtagctgaggatgtcttcgctgccaagcagctggatgcctggcaaatcgcgtagtaagtcctgcccatccgccgcctgcccatggcgatagttgagcaggctgttgaacagcggcgtcgctgcggccaccccgctgcaccgctgggccagcgccagcggcgcgtgttcgtgggcgagcaaggcgctcaagcgcctgtgggtttcgcgaagggcatccgccgccgtctgcccggccaggtcgaggcgcagcggcaaggtattgataaacatgcccagggcgcggtccgccccggcgccggcctgcaagcgccccagcagcaccgtgccgaacaccacatcctcacgcccgcacaggcgccccagaaccagggcccaggccaggtggaagacgctcgccgcgctcaccccctgggcccgggcctggccgcgcaggcgtcgggccagggtcggcgccagccggcattcgactttctcatgcacgtcatccgcggtcgtgcgctccagccggccgaaggccaggctcggctcgtcgacgtccgccagccatgcgcggaagaaggcttggtgttcctcgtcgcagctgcccaggcgggtctgcgccacatagcggcgataaggcaccgcctccggcaactgcgctgcccggccctgcagataagcgtggatttcctccagcagcacgccagtggaggtggcgtcgttgaccagatggtggaagcgcagcatgccgacccaacgctggttccgcgggtcttcgctgtaggccagggccatcatcggcgcccgccccaggtccagcggacgcagacctgggtcgaggcgctcgcgcaactgcccggcgatatcgccggcctgcgagtccggcagcacttcctcgagttgcagccgggcctggcgccagaccacctgcatgggttgctccaggccgttccagaccaggctggtgcgcaggatgtcgtgccgcgcgatcacctgttgcagggcctgggcaaaggcatccaggcgctgccggctgtcgaaggcgaacagcgcgtgctgctggtagggatcgcgcgcctcggtcatgtggtgatagagcagcccttcctgcaacggcgccagggggtagatctcctgcacattggccacgccgccgggcaccgtggcgacgatgcgctcgatagtcgcctgatccagctgcgccagcaccagcatgtccggggtgatgcgcaggcagtccgggacgatacggttggccggcacctcgacttcccgggtgccgccgaccgccgccgccaggctggccagggtcggctggtcgaacagcacccgcacatcagcctgcaacccggcctggcgcatgcgttccaccagggttaccgccagcagcgaatgcccgcccagctcaaagaaatgatcctggcgcccgacccgctcgacctgcagcagctcagcccaaatcgccgccagccgggtttccaccgcgccctggggcgcctcgtaaccgcgagtgataaaggcctcctgccccggcaccggcaaggcccggcggtcgagcttgccattggcggtcagcggcagcgccgccagccgtacataggccgcgggcaacatgtagtccggcaggcggctttgcagctgggcatgcagctggttgatttccagtggctgcggcgagctggacggctcggtgaaataccccagcaggcgcccgtcgcggacctggaccaccgcctcttgcacgccgctcacggccgccagggcgctttcgatctcccccagctcgatgcgcatgccgcggatcttcacctggtcgtcgttgcgccccaggtattcgagcgtgccgtccgccagccagcgcgccaggtcgccggtgcggtacatgcgcgcgcgctgccccgcaatgacaggttcatcactgaagggatcatcgaggaaacgttcggcggtcagttcgggacggttcagatagccccgcgccaccccggcgccggccacatacagctcgcccgccacgcccaccggcaccgggcgccgctgcgcgtccagcagatagacccgggtatggtcgatgggccggccgatatgcaggccctggccgaccatgacccgcccggaggtggcgaccaccgaggcttcggtggggccgtagttgttgatcacggcaaaccccggctcctcggcgaactggcgcaggcggtcgccgccaatcagcaaggtgcgcagcgttggatggcccagccgctggttgaaggcgtactcggccaccggggtcggcagaaagctcacgtccagcggctgggcgcgccaccagtcgagcagcgcctcgatgtcttcgttgccgtcgcgggccggtggcaggtgcagggtcgcgccgctgcacagggccggccagacttcccaggccatggcgtcgaaaccgaaaccggcgaggctgctggcctggccgcccggccccaggtcgaaggccgaacagtgccagtccaccaggttggccagggtccggtgctcgaccatcacgcccttgggcaagccggtggaaccggaggtgtagatcacataggccaggtgcgccggggtcagcccggggacctgcggattgctctgcggctgctcccgccagtcgaaggcatcgagttcgatcagcggcacgctcagggccggcaggcgcgccagcaattcagcctgggtcagcaccgccagcggcgcgctgtcctgcagcagatagctcaggcgctcggccgggtgggccgggtcgatcggcacataggcggccccggccttgaggatcgccagcaggccgaccagggtgtcgaggccacggcgggcgactatggccacccggtcatcgggctgcacgcccagcgatcgcaagtgatgggccagagaattggcccgttggttcaactcggcgtaagtcagcgactgccccaggcagaccgctgccaatgcctggggccgcgcggccgcctgggcttcgatacgggcatgcaacggctggctgcaggccggcgccgggccgctggcgttccacgcttgcaacaaggccgtgtcgcgggcaccgagcagcgagaactcggcgatcggcaggcgcgggtcggccagtccctgctccagcacatgcaccaggcgctcggccagggcctcgatttccccgccctggaaatacgcctcgttgtagaggtaatgcatccacgccttgtcgttgtaactgttgctacgcaggtggatggccaggggcagcggctcgtgcccgttgcagaccttgaccgaatgccccagcgcctcgccgtagcggtaatcgtggtcgtcctgctcgtaggacagcgacaggtcgaacagctgcccgcggtcctcgcgcagcaggccgagggagcgattcatctcgctcagcgggaagcgctgatggcggaagtcctgcttgagcacgtcgcgcaccgcccgcaccagctcgccgaacggcaggtcctggctgaagcagaaacgcacggcgctgacctgggtgaacagccccagggtgtttttgaaacgggcattggaacggttgagaatcggcagccccaccacccactcgtcgcgttgcgaggtgcgggtgaagtagacgtacagagccgccagcaacacatggaacgccgaggcctggcaggttctcgcccactgtttcatgcgctcgtgcaaatgcatggggaacgcctgcagcagattgttgctcggggtgtcgccgctcgccgcggcctccctggcgaagcgctcgcgataacgcggcatcagcagcggttcgggcagcgtgcggtacttgtcctgccagtacgcccggtcgcgcaggtaacgcggcgaatcgtggtagcgcgcatcgtcgcgaatgaactcgacataggatggcgccgacaactcggggcggcgtccggcctgcagcgcgctgtagatcccgcccagggattgcagcatctggccaaagccccagccgtcgagaatcagatggtgggcctgggtgcccagcaggtgatggcgggcatccaggcggaccaggaagaaccggaacaacgggccgccatcgaagcggtacggctgttccatgcgttgccggatcaaggcctgggcggccgccagcggctcggggtgggcactgaggtcctccagcggcacctcgaccggcatgctctgggcgaagcgctgcaaaggcaggccgtcgctaccggcgtcgggcagcaacacggtgcgcagggcatcgtgcttgcgcaccagcagctcgatggcctgctgtatcagctcggcgctgaaaggcccggcgagttcgacgtagccgccgatgttgtacagcggtgaatcgccccggctcagctggtcgagccagatatcgcgctgggcggcggtcagggcaaaggccggcgacgcaaccttggacagggtcatggccggccctcccggaaacaggtggccgtcgaacggccgggctggcggcaagggttctcgatcgcgacaaacgcgcctggggcggctgcgaaacaaagcttcataagatccttctcatgtgaggtgtccataccttgaaccatgccctgagcagagcccgacagcgcctgtaatcgcaggctccatggatttaaccatcgccctggcgacctgtatgtcacctgaaacccggacagcctggcgcgggctcgagccgggctgaatgggtagtcgaaaattgacttggcgccaggctcaggactggtctgcgcgcacgtactagctaaaaattcccgtttcaaaggcttaaaagcgtgtaggaaatccactacaggttccggacggcgttcagggttaaaagcaccgccctgtcagataaatctgatgaatatcaaagaattatcttaatggtcaggccgccaacagccctggcaaaatcgccctttggggcgaaatccgccccattaacagcgcgttttttatggcaggttgtgtccccgctttcagctacagacgctggataaacccgcgggattaaatgaaaaaaccggccacaaggcttagttgcaagcaccggcggtggccgccactccaaccgttcgacgatctgtctacatcaaggatgatagggatatgagtctgaccagcagtattcgaaacatagacagtgcgcatttctacaacgaattgggggcgctgatttccaacaccggcaatgggctgtttgcggcgaagatgctgcacctggtggacaagctggtgcctgtgcagcgggtcgaactcgccgaatggaacctcgacgaacgccaggcgagcattcttcagatcaagccgctgggcagcgccgggctcgaggaggcactgccgcccacccagccctcgcagtaccaggacgatcatccgctgctggaaaagatgatcgaaatgaacgactcgctgctgatccagatgaacgcccagaccgccagcaaacacccgcgttacctctcccaccagtgccatctggtgtcgcgcaaagccagtcgccgctgtgtcatcaccttcctgcgcccgcctgcgcaacggctgttttccctggccgagctgtcgtttctcaagagcctctcgcaaaccctgctgccgctggtggagcgccatgcccaggtcacccgccaggcctgtcagaaaaacctcggccacgcgcccgacagcccgctgacggccatcgagcaatcaccgctgcaacgggaattcaacgaacggctgtgcctgggcgacatcaccctgtcggcgcgggagaaagaggtctgcctgggcctgctgaccggcggcacggtgccggaaatggccgagcgcctgagcgtcaagaacagctcggtggaaacctacctcaagcgcgccgccgccaagctcggggtcagcggccggcacggcctggcgaaatggatggtcggcgcctgagccacgccctgcccgcttttcaacccgcccggggcgacgccgccgtggcttttgcagatgagactgttcaatgagtaactccccgctgtccctggtgagccttgcgttggtgctgggcggctgctcgctgataccagactaccggcagcccgcggcgccggtcgggtcgcagtacccgcagggccccggctatgcaacctctgcgacccaggccacccaacctggagaaccgggagcggactggcaaagcctgttccacgacccggagctgcaaacactgatccgcagcgccctggtcaacaaccgcgacctgcgggtcgcggccttgaacgtcgaagccttccaggcccagtaccggatccagcgcgccgacctgtttcccgcggtgtccgccaccgccgccggttcacgccagcgcgtgccgggggacgtgaccggcaccggcaaggcgctgatcaagtcgtcctactcggcgaccctgggggtcagcgcctatgaactggacttcttcggccgggtgcgcagcctcactgagcagaccctgatgagctacctggccaccgagcaagcccggcgcagcgcccagctcagcctggtggcgaacgtcgccggcgcctacctgacctggcgcgccgaccaggaactgctggcgctgaccgccaagaccctggtcgccgacgaagaaagcctgcgcctgaccagccgcagtgccgaggccggcaaggtctcggcgctggatgtgagccaggcccggaccagcgtcgaaaccgcccgcgccaacctggcccgctaccagcgccaggtggcccaggacctcaacaatctgaccctgctggtgggcagccaggtcgccgattcgctgccggcccggccgctggccagcgacctgatcgcccaggtcccggccgggctgccctcggacctgctgcaacgccgtcccgacatcctccaggccgagtaccagctcaaggccgccaacgccaatatcggcgcggcccgcgccgcgttcttccccagcgtcagcctgaccgccaacgccggcacctccagcctggagctggccgggctgttcaagggtggctccggcagctgggccttccagccgcagatcaacctgccgatcttcaatgccggcagcctgcgggccagcctcgactacgcgaagctgcaaaaggacatcaccatcgcccagtacgaagagtcgatccagaccgccttccaggaagtcgccgacggcctcgccgcgcgccagacctacagcgatcagctcgacgcccagcgcagcctggtggcggccacccaggactattaccggatggcggaacaccgctaccgcaccggcgtcgacagcaaccttacgttcctcgacgcgcaacgctcgctgttcagcgcgcaacaggggttgatcaacgaccggctggcgcaactgatcgccgaggtcaacctgtacaccgcgctgggcgggtcctggaaggaggaatcgaacccggcgttggcccagcgctcgccctgacagcagcgcgatgaccgggccacgacaccggtcatcgcgccgccgtcgtgagcttcttgttaaggcaaaaaagccgatctatacctcaacaggccgtttgcaacggctgaagcaacccgggcttcgtcgcgcctgcagcgagccaggcattcaacgcaccggacaactggacagaggcatcaccaaggagcggtcatgagcgcaaaactattagtcaaatggatcaacagaaccgatcggcacccccacggggtctgcgaggcggccgtgatgaagtggctggcggcgatcgataactccggcctgggccaggccatgaagctgacaccccagcaatgcgatgatctgcaggatcaggtggaagacggagagacgttcgttttcctgctgccccccctgctgctgcctacttcaagtttcgacccgttcaacccggtgccgaccactgtggattcgctgaaggccctgaaggcggggaacttcatcttcgtgtccgccgagggccacagtgtggccggcggcgggcatgcgatgggcatctacaagaacaccaccaacctgttcttcttcgatcccgaactggggatctatgcctatgacttcaacagcgcagcggacctgagcgaaatcgtcaagaaaacccagaactacgggaaggcggcttattgcccaggcacctttaccccaccgccaaaaccttgagccaatgcgccctcgcagcgtgccctatgcgctgcggggcgcagatcccgggcacaaaaaaaggttcttcacggaatcccgggaaacacagaaacaagaacgccgatttgattgatgatgttcgtgcgagcaaacacatctaacaaaccggcgttcttatgcgtgatattaatactttccttcccttttgggagggcttttctgtcgtcacgatcaagcctgatggtgacgcgctccagatcgatctgattccccacgccacccgattcccttcctgtggcggctgccaaaaactctgttcaaccacgcatgagtactgccagcgagtcatccgcgatctgcccattcttggccgagcagtgcgcctcagcgttttgcttcggcgtgtcggctgtcgggactgtggcaaacgcatggaggccgtcagttggctggatcgctatgcccgcatgacgcgccgcctggccgatgcggtcattcaggcctgcgagcgccttcccacgctacacgtggcccaactgttcgggttgcattgggacagcgttcgcttgctggaacgtcgcgccttgcaagcggcattgagtgttttgccaaaggcgcagccacagcgcttggtcatggacgaatttgccctgttcaaaggtcatcgttacgccagcgtagtgctggacgccgatacccggcgagtgctgtggattggcgaaggccgcagccgggcggcagtcagaccctttttcgaagagctggggtcagagggttgcgctcgcatcgaagcggtggcgatggacatgaacactgcctttgacctggaggttcgtcagcactgcccaaaagcgcgcgtggtctacgacctcttccatgtggtggccaagtatggtcgagaggtgattgatcgagtccgcgtcgatgaagcgaatcggctacgtcacgacaagcctgcccgcacggtcatcaagcaggcgcgatggctgttgctgcgcaatcggcagaacctgaaaacgccggaacaacaagtccgcctggaggatctgctggcggccaaccaagcgttgatgacggtctatttgatgaaggctgaactcaaaacgctttggacaccgagcaccgcctggggctggcgatcagcctggcgacaatggctgcgccatgcgcatgaaagcgacataccgcctctgatccagtttgccaaacgactgaagggttactggcggggcatcgtcagccgggtgcgctggccaatgcatacgggccagttggaaggcatcaacaatcgaatcaaggtcatcaagcggatggcgtacggttaccgggacagcgaattctttttcatgaagatcaagagcgtctttcccggtaatccgtgaagaacccaaaaaaagccactgttcgagtggcttttgcaccctgaggcagccgatggttagcctacccggacctgcggcaaacgaatcgcccccggaaaaaggagaagccattgaaattaaagtcagccacgtggatgtgctcgtcaaagacctcgagcaagcgtatgcgtattacgcccgggtcttcagcgcaaggatttccaagaccctggattggcagcgcgacggtctgcatgtgcgttatgcgatcgtcatgttcggcacggagcgcctgatgctggtgcaaccctttgccggaaatctcaaggcgctgatggacagcaacggcgaaggcacgatctaccgtcactgctatagcacgccggacatcgaggccgcctacgacgagttgctggccgcgggagtgcagccggaagacgagaacagcaaccccctgtcgcgcgacaatctccagtctcccagcggcacacgcatcctctggctgccgaaacgctttgggcatttctccatcgagctgcttgaagaggtggagctggaggccttcatcgaggacgcattcgccgaggacaggtaaggcgacaggcgccagcactcccccctgccgcataggctgaaactcccagacggcctgggagtatcggccaatgcgcaacctcctgcgcatccccatagttgtgacatctgccagcagaggggcccaggtgcggcccccacaactagaagcgccgaggagcctgccatgaccacaccccaatcccccaccaccgacctgaccgctgatacccctcccgatctgtaccccgtcttccccagcaacgacacactgaccaccaccgccctggcggatggcgctccgctcgtggtagcgaccggcgccaacgtcaccttggacgaaaccgccgggttgcagaacgccacggccacgccagcccccgcgggcgacgccgacgacaatgacatcctgctggccgccctgccctcggccttcgccacccgcttgaccgccctcggggccggtaccgcgacggacgcggccttgagcggttataccggcgccgtgggcgacaccggcagcaatgccttcaccctcaacctggcgcccggcgcgaccaatatcgatatcagcttcaccgacagcctgggcgctccgctcaatggcctggacagtggcttggacaccctcgatggcaccagcatccttctgtataccgataccgacaacaacatcctgctgggccgggccggcggccctgccggggcgatcgtgttcgccgcctacatcgaggaaaccggatcgccggtcagcggcggcaagatctggaccgtggaataccaaccgctcaagcatccggacggcagtaatccggacgatgccctcaacctgctgaataaagtcttcatcggcgccagccaggacctgacgttcaacctggccaacgcgccttccgggcagaacctgttcctgatgttcaccaaggccagcccgacggtggtcgacgacggtggcgtcctgcggatcagcgacccgacgatcatcgccaccggcaaggaccccgccgaccagtcaagcggcgtcaacatcagcaccggcgacaccatcaacaccagccaggccggtggcccgaccaccttcggcaccaacagccagatgatcacggaacaggaaggcattcgttttaccttcgtcaccggcgcccggcaggacgtgaccattcccaacctggatcagaacgaagccgatgtcgaagccaatatcgacttcaccgcgatgttcaatgccaaggcggccaatttcgatatcgtgcaactgcaaagcggcaagagtgcggtggtcaagatcagtgccttcaacaccgcggttgaaagtggcgcgagtttcgtcaatggctatgccaacgatacgtcggtggccattaccaatgttcgcgtgatcaacatcgccaccgggctggtgatcgaaaactccgacggctcggtgaatgatccaagcattgccatcagtttttctggcggcgtggccaccgtcaccggcgtcaaggccggttaccagatcgaatacaccacggccgcggaccacaaccgggtactgatcgagaacggcgcggcgctcgacgccaagggcaatacccacgccgacttcgatatcggtggcttcaccctgcgccaagcctccaccacgaccaccgaaatcggctcgcagatgatcttcgaggacgatggaccgaccctcgccttcggcaacctgatcggcaccgggaccgccctggcgcaacaaggctactggaacatggcggccggcgccgacgggctgggggcgaccggcctggacattgcgctggtgaacggccagttcaccctggtccggccggataatacgaccaccaccggcaccggtacgctggtcgagcagtcgccttcaccggatggcaatggcgcctaccagttcgccggcaccctcaccggtgatttcgacaacaacgcggccaccgccgataccactgtccattacaccctgagcgcctacgccaacggcacctatgccctggacctggaggaaggcttccgttcgaccatcgtcctcagcagtgccgacggctcgctgactgccggtggtccggacccggtgcgcacgctgatgatcggcagcgaggatgtggtgttcttcgccgccaatccgctggcaccgcagaccggcgataacagcatcctcaccggtatcgggctcggggcgcccgaccctaccgaggcgcagttgcagaccaacccgctgccgtcgtacatcggctcgtcgaccatgaacgtcagcacctccggcatcggtgtcgccaacaacaacctggagggcaacaccaccgccggcatcaatgccggcgacgaaagtttcgtgatcaaccccgagaccttgttgacgagcatgaagatcttcatcgacaactccgtgggcggctacaacccggccaccgaagagctgtattacacggtctacttcgacaacggcacgacctcgggcgcgcccatcaaggtacaggccgccgacctgcacgcggaagcgggaaaccagaaatccttcaccgtccagtgggatggcagccacctgatcgacgccgtccagctgacgatgggcctgggcacggtcaaggtcccggtgatccagttcatcaaggaaacccagagcctggccagcgatatccagctggcgttcaacgccacggtgacagacaaggatggcgatacggcaaccagcgcgttcgatgccaacctgttcgccaacgacccgagcgaccagagcttcgacttcaggctggtcggtaccacgggtgaacgggatgccttcaacatcgacctgtcggtggccgagaaccagtaccaggtcagcggcttcgatgcgggcgcaggccagcgcgatgcggtggtgctcattggtgacgcgggggccgtcgtgcaatcggtcgacaacactggcgccgacagcgtggtgacggtgaccgagaccggcgggcaagtgacgaccatcaccctggtcggggtcgatctactcaataccgacattgtcctggccagcgtctgaaacctggcacggcaaacccaagcgagagcggcctggaaaccgccctcgcttttttttacagcatcaataggccttgcttgtcgcgccgaatgcgggcagcaccaggcttgaaaagcaggcaacagaccggcgcctgcgcctcatcccgtttccccgcccaagtaggctgaaactcccagcccgcctgggagtatcggccaatgcgcattctcccaggcatcctcatagttgtggcatctgccagcagagggcccagtgcggccccaatggctggaactgcctaggagaattgtcatgactaccctccaagaaaacctatccctcacgggcgacccgctcgtggtagcgaccggcgtcaacgttgcgctggacgaaaccagcgggttgcagaacgccacggccacgccagcccccgcgggcgacgccgacgacaatgacatcctgctggccgccctgccctcggccttcgccatccggctgaccgccctcggggccggtaccgcgacggatgccgccttgagtggctataccggtgccgtgggcgacaccggcagcaatgctttcaccctcaacctggcgcccgatgcgatcaatgtcgatgtcggcttcaccgacagcctgggcgcaccgctcgacggcctggacagcggcctggataccctcgatggcaccagcatccttctgtataccgatacggataacaacatcctgctgggccgggccggcggccctgatggcgcgatcgtgttcgcggcctatatcgaggaaaccggatcgccggtcagcggcggcaagatctggaccgtggaataccagccgctcaagcatccggacgccagcaacccggacgatgccctcaacctgctggacaaggtgtttatcggtgccagccaggacctgacgttcagcctgaccaatgcgccttccgggcagaacctgttcctgatgttcaccaaggccaacccgacggtggtcgacgataacggtgtcctgcggatcagcgatccgacgatcatcgccaccggcaaggaccccgccgaccagtcgacgggggtcaatatcaataccggtgacaccatcaacaccagccagggcggtggcccgaccaccttcggcaccaacaaccagatgatcgtggaacaggaaggcattcgctttaccttcgtcaccggcgcccggcaggacgtgaccgtgcccaacctggatcagaacgaagcggacgtcgaagccaatatcgactacaccgcggtgtttaatgcgacgacggccagtttcgatgtcgtgcagttgcaaagcggcaagagtgccgtggtcaagatcagtgccttcaataccgcggttgaaagcggcgtgaacttcatcaacggctatgcgaacgacacctcggtggcgatcaccaatgtccaggtcatcgataaaagcaccgggctggtgatcgaaaactcggacggctcggtgaacgatgccaacattgccatcagcttcgatggcggcgtggccaccatcaccggcgtcaaggccggctaccagatcgaatacaccacggccgcggaccacaaccgcgtactggtcgagaacggcgccgccgtggacgccaggggcaatgaccacgccgacttcgacatcggtgccttcaccctgcgcgaggcctccaccgcgaccgccgaaatcggctcgaagatgatcttcgaggacgacggaccggccgcggccggaaccgccgaggccggcaccgtcgatgaagacggcctggccaatggcattgccggcggtatcggcgacgtgcctggcgaggtcaccagcgccagcggcaacgtcagcgggatcttccagtccggcgtcgacgtgccgctgacgtactccctgtcgagcgacaccagcggcttgccagccctgacttccggtggagtggcgctggtgtatagcgtggtgggcgacaccctgaccgccaaggctggcgccgtcgatgtgttcaccttcagcctcagcgcagcgggcgcgtatagcttcactctgctgcaaccgctggaccatccagcgggcaacgatgaaaacgacatcaccctcaacctgggcgcaatgttgaaagccaccgacaaggacggcgacacggtaacggccgccgccgagaaactggtgatcaccgtcgatgacgacaccccgaccctggccttcggcaacctgatcggcaccgggacccagctggcgcaacaaggctactggaacctggggtctggcgccgacgggctggatgccaacggcctggacatctcgctggtgaacggccagttcaccctggtccggccggacgatacgaccaccaccggcaccggtacgctggtcgagcagtcgccgtcaccggatggcaatggcgcctaccagttcgccgggaccctgaccggtgacttcgacaacaacgcggccaccgccgataccaccatccactacaccctgagcgcctacgccaatggcacctatgccctggacctggaagaaggcttccgctcgaccgtcgtcctcagcagtgccgacggctcgctggatgccggtggtccggatccggtgcgcacgctgacgatcggcagcgaagacgtggtgttcttcggcgccaacccgctggcaccgcagaccggtccgaacagcatcctcaccggtatcgggctcggggcgcccgaccctaccgaagcgcagttgcagaccaacccgctgccatcgttcatcggcacctcagccatgaacgtcagcacctccgggatcggcatcgccaacaacaacctggagggcaacaacacggcgggcatcaatgccggtgacgagagtttcgtggtcaaccccgagacgctgttgacggccatgaaggtctatatcgacaactcggtgcagggctacaacccggccacggaagagctgtactacacgatctactacgacaacggcacgacctcgggcgcgcccatcaaggtgcaggccgccgacctgcaggcggaggccggaggccagacctccttcaccatagagtgggacggcacccacctgatcgacgccgtccagctcaccatgggcaagggcacgatcaaggtgccgaccatcgagttcattcacgaggtccagagcctggccagcgatatccagctggcgttcaacgcgacggtgacggacaaggatggtgatacggcgaccagtgcgttcgacgccaacctgttcgccaacgacgcggccgacgcgctcttcgacttcaggctggtgggtaccaccggtgagcgggatgccttcaacatcgacctggcagccaccgagaaccagtaccaggtcacaggcttcgatgccggagcaggccaacgcgatgcggtggtgctcatcggtgacccgggcgccgtcgtgcaatcggtcgacaacactggcgccgacagcgtggtgacggtgaccgagaccggcgggcagataacgaccatcaccctggtcggggtcgacctgctcaataccgacattgtcatgggcagcgtctgaaacatcgcgcgtcaaccccaagcgagggtggcctggaaaccgccctcgcttttttttgcgcgccgatacaagcgctgcggcgaacgctcaagcagcccgtcgaatcgctcgacgacggcctgtcgccggccatcgcaggctaaccaaatgccccccgggggccttcgcgcgatcgctgtcctgcctcctcccgtgtcccctgccgcatgggctgaaactcccatccggcctgggagtatcggccaatgcgcaaccggcgtggcatctccatagttgttgcatctgccaacaggggccccgggtgcggcctcgatgactggcatcgctcaggagaaatgccatgaccatccctccaaaaatcacatccaccacgaacgacctgaccaccacccaaccggactgcgatccccccttcctggtgttcggcgatagcgtgaccctggacgaaaccagcgggttgcagaacttcaccgctacgccaagcccggcgggagacgccgacgacaatgacatcctgctgtccgccctgccctcggccttcgccacccgcttgaccgccctgggcgccggtaccgccatggacgccgccttgagtggctataccggtgccgtgggcgacaccggcagcaatgccttcaccctcaacctgacgcccggcatcagcgtcctcgatatcaagttcaccgacagcctcggcgcggcgctcaacggcctggacagcggcctggataccctcgatggcaccagcatcctgctgtacaccgataccaacaacaacatcctgctgggccgggccggcggccctgatggcgcgatcgtgttcgcggcctatatcgaggaaaccggatcgccggtcagcggcggcaagatctggaccgtggaataccaaccgctcaagcatccggacgcgagcaacccggacgacgccctcaacctgctgaacaaggtgttcgtcagcaccgtccaggacggattcgacctgaccaatgcgccttccgggcagaacctgttcctgatgttcaccggggcgaacgcgacggtggtcgacgatggcggtgtattgcgggtcagcgatccgacgatcatcgccaccggtaaagacccggcagaccagtcgagcggcgcgaacataaacactggcgacaggatcaataccagccagggcggtggtggggtcaccatcggtaccaacaaccagatgatcacggaacaggaaggcatccgcctgaccttcgtcaccggcgcccggctggatgtgaccgtgcccaacctgagccagaccgaagcggatgtcgaagccaatatcgactacaccgcgatgttcaatgcgacgacggccagtttcgatgtcgtgcaactgcaaagcggcaagactgccgtggtcaaaatcagtgcctacagcacggcggttgaaagcggcgtgaacttcgtcaacggctatgcgaacgacacctcggtggccatcaccaatgtccgcgtcttcgataaaagcaccgggctgctgatcgagaattccgacggctcggtgaatgatccgggcatcgccatcagctttacgggcggggtcgccaccgtcaccggcgtcaaggccggctaccagatcgaatacaccaccagcgccgatcacaaccgcgtactgatcgagaatggcgcagccgtcaacgccaggggcgataaccacgccgatttcgatatcggtggtttctcgctgcgccatccctccacgatcaccagcgaaatcggctcgcagatgatcttcgaggacgatggaccggcagcggccggaaccgccgaggccggaaccgtcgatgaagacggcctggccaatggcattgccggcggtatcggcgacgtgcctggcgaggtcaccagcgtcagtggcaacgtgagcgccatcttccagtccggcgtcgatgtgccgctgacttactccctgtcgagcgacaccagcggcttgccagccctgacttccggtggagtggcgctggtgtatagcgtggtgggcgacaccctgaccgccaaggcgggcgccgtcgatgtgttcaccttcaacctcagcgccacgggcgcctacagctttaccctgctgcaaccgctggatcacccggccggtaacgatgaaaacgacatcaccctcaacctcggtaccttgctgaaggccaccgacaaggatggcgattcggtgacggctgccgccgagaagctggtgatcaccatcgacgacgatacgcccaccgcgaccggcgtcgccgaggccggaaccgtcgatgaggatggcctggccaatggcatcgccggtggtgtgggcgacgtgcctggcgaggtcaccacggccagcggcaacgtcaccgggatcttccagtccggggccgacgtaccactgacttactccttgtcgagcgataccagcggcctgccagccctgagttcaggcggagtggcgctggtgtatagcgtggtcggcgacaccctgaccgccaaggccggcgcgatcgatgtgtttaccttcagcctcaatgccgcaggtgactacagctttaccctgctccagcccctggaccatccagccggtaacgatgaaaacgacatcacccttagcctgggcgcgatgctgcaagccaccgacaaggatggcgatacggtgacagctgcggccgagaaactggtgattaccgtcgatgacgatacgccaaccgccgccggaaccgccgaggctggaaccgtcgatgaggacggcctggccaacggtattgccggtggtgtcggtgacgtggcgggcgaagcaacgacggccagcggcaacgtcacgggcatcttccagtccggggccgacgtgccgctgacttactctctgtcgagcgataccagcggcctgccagccctgagttcgggcggagtggcgctggtgtacagcgtcgccggcgacaccctgaccgccaaggcgggtgccgtcgatgtgttcaccttcagcctcagcgcggcgggcgcgtatagcttcaccctgctgcaaccgctggatcatccagcgggtgatgatgaaaacgacatcacaatcaacctgggcgcgatgctgcaagccaccgacaaggatggcgacacggtaactgccgcggccgacaaactggtgatcaccgtcgatgacgacacccccaccgcgaatggcaccgctggggccggcactgtcgatgaggacggcctggccaacggtattgccggtggtgtgggcgacgtacctggcgaagcgacgacagccagtggcagcgtcacggcgatcttccagtccggggccgatataccgctgacttactccctgtcgagtgataccagcggtctgccagccctgagttcgggcggagtgacgctggtgtacagcgtcgccggcgataccctgacggccaaggccggcgcggtcgatgtattcaccttcagcctcaatgccgcaggtgactacagcttcagcctgctccagccgctggatcatccggccggcaacgatgaaaacgacatcagccttaacctgggtgcaatgctgcaagccacggataaggacggcgacacggtaacggctgccgccgagaaactggtgattaccgtcgatgacgacaccccaaccgctaccggaaccgccgaggccggtaccgtcgatgaagacggcctgaccaatggcatagccggcggtatcggcgatgtgcccggagaagccaccacggccagcggcaatgtgacggcaatcttccagtccggtgccgacgtgccactgacttactccctgtcgagcgataccagtggcctgccagccctgagttcgggcggcgtggcgttggtgtacagcgttgccggcgataccctgaccgccaaggccggcgccgtcgatgtattcaccttcagcttcagtgccgccggtgcctacagctttaccctgctgcaaccgctggatcatccagccggcaacgatgaaaacgacatcactctcaacctgggcgcgatgttgcaagccaccgacaaggacggcgatacagtgacagccgccgccgacaagctggtgattaccgtcgatgacgacacacccaccgcaaccggcaccgccgaggctggcaccgttgacgaggatggcctggccaacggtattgccggtggcgtcggggacgtggctggcgaggctaccaccgccagcggcaatgtgacgggcatcttccagtccggggccgacgtgccactgagctatgccctgtcgagcgacaccagcggcctgcccgccctgagttcgggcggcgtggcgctggtctacagcgtcgctggcgacaccctgacggccaaggcgggcgccgtcgatgtgttcaccttcagcctcagcgctgcgggtgactacaacttcaccctgctgcaaccgctggatcacccggccggcaatgacgaaaacgacatcaccctcaacctgggcgcgatgctccaggccacggacaaggatggcgacaccgtgacggccgccgccgagaaactggtgattactgtcgatgacgatacccccaccgcaaccggcactgccgcggctggcaccgtcgatgaagacggcctggccaatggcattgccggtggtgtcggcgacgtggccggtgaagccaccgtggccaatggcagcgtcagcggtgtcttccagtcgggtgccgacgtgccgctgacttactccttgtcgagtgataccagcggcctgccagccctgagttcgggcggcgtggcgctggtctatagcgtcgcgggcgataccctgacggccaaggccggtaccacagatgtattcaccttcagcctcagcgccgcgggtgcctacagcttcaccctgctgcagccgctggatcacccagccggtaacgacgaaaacgacatcaccctcaatctggggaccttgctgaaggctaccgacagggacggcgacaccgtgacggccgccgccgagaaactggtgatcaccgtcgatgacgacacgcccaccgcaaccggaactgccgcggctggcaccgtcgatgaagacggcctggccaatggcatcgccggtggtgtcggtgacgtgccgggcgaagcaacgacggccagtggcagcgtcaccggcatcttccagtccggggccgacgtgccgctgacttacagcttgtcgagtgacaccagcggcttgccagtcctgagttcgggtggggtggcgctggtctacagcgttctgggagataccctgacggctaaagcgggcgcagtcgacgtattcaccttcagcctcagcgctgcgggcgcctacaacttcaccctgttcaagccgctggatcatccagccggtaacgatgaaaacgacatcaccctcaacctggggaccttgctgaaggctaccgacagggacggcgacacggtaaccgccgcggccgagaaactggtgattaccgtcgatgacgatacccccaccgcaaccggaactgccgcggctggcaccgtcgacgaggacggcctggccaatggcatcgccggtggtgtcggcgacgtaccgggcgaagcaacgacggccagtggcagcgtcaccggcatcttccagtccggggccgacgtaccgctgagctactccttgtcgagtaacaccagcggcttgccagccctgagctccggtggagtggcactgacctacagcgtcctgggcaacaccctgaccgccaaagccggcgcgactgacgtgttcaccctcagcctgacggtagcgggtgcctacaccttcagcctgctccagcacctggatcacgcagcgggcaacgatgagaacgacctcgtcctcaacctgggcaccctgctgcaggccaccgacaaggacggcgacaccgtgaccgccgcggccgacaaactggtgatcaccgtcgatgacgacacgcccaccctggccttcggcaacctgatcggcacggggaccgaccaggcgcaacaaggctactggaacatggccgccggcgccgacggactgggtgcggccggtctggacatcgcgctggtgaacggccagttcaccctggtccggccggacgatacgaccaccaccggcaccggtacgctggtcgagcagtcgccgtcaccggacgccaatggcgcgtatcagtttgcgggcaccttgaccggtgacttcgacaacaacgcggccacggcgaacaccaccgtgcactacacgctgagcgcctatgccaacggcacttatgcgctggacctggaggaaggcttccgttcgaccgtcgtcctcagcagtgccgacggttcgctggatgccggtggcccggaccccgtgcgtacgctgaccatcggtagcgaggacatcgtgttcttcggtgccaacccgctggctccggcaagcggcgcgaacagcatcctgaccggtatcgggcttggagcgtccgaccctaccgaagcgcagttgcagaccaacccgctgccgtcgttcatcggcacctcggccatgaacgtcagcacggccggtatcggcatcgccaacaacctgttccagggcgacaaccaggcggcgatcggcgcggccgatgaaagcttcgtgatcaacccgcaaagcctgctgacgagcatgaaggtgtttatcgacaactccgtgggcggctacaacacggccaccgaggacctgtactacagggtcttctatgaagatggcaccttctccaacctgatcgaggtcaacaccctgacaccagaggccggtgggcaggtgtccttcactgtcgggcaatcggccacatcgctgatcgatgcggttcagctggtaatggcccggggcgagatcaagatcccgacgatcgagttcacccacgagaccgagagcctggccagcgacgtcaagctggcgttcaacgcgacggtgacggacaaggatggcgacaccgcgaccagcgcgttcgatgccaacctgttcgccaacgacacggccgacgcgctcttcgacttcaggctggtgggcaccaccggtgagcgggatgccttcaacatcgacctgtcggtggccgagaaccagtaccaggtcacaggcttcgatgccggagcaggccagcgcgatgcggtggtgctcattggtgacgcgggcgccactgtgcagtcgatcaacaacgccggcgccgacagcatcgtgacggtggccgagacgggcggacagataaccaccattaccctggtcggggtcgacctgctcaataccgacattgtgatgggcagcgtctgaaacatcgcgcacgcgaacaaaagcgagggtggcctggaaaccaccctcgctttttttgccgccaccgtccgaaaaatcctcgatcgtatccgcggcaagtgcccaggcagcgccaagagcgcgacggcgtgccagcgcattcatgggggcaggaaacgatgagcacggcatcgccctcggcctgggcacccaggtcgacgacgacaaggacagcgacaagaacagccaccgggctgccttgtcttgatcaactcattccagttccacccacgtcgagtcgggcggctcttcatcatcggtgagcccgtgcttgagcgcatacatcagcaagtcgatgcggttgatcaggttgagcttctgatagatgttgctgaggtggttgtgcacggtgtgttcactgatacccaggcgctcggcgatgctcatgtatttggcggacgggtcgccgacgatggcgcgaatcagctcccgctcgcgcagcgtcagccgcgcctgcttcgcctgctccaggttgcatcgcatgggtacatgccgggtcgcggcatagccggaaagcccgccggaccaggctcggtccagtccgacgtcgtaatggtggaccttgatgatggcccggacgatcgattccgtcgggtcttccgccagcacgatgccacgcgcgcccgcctcgatcgcctgggcaaccgggacggattcgtacaggcccttgagcaccagcaatttcatttccgggctgcgggtcagccccgcgacgacctccagggggttcaacgcatccggaaagaaactgaaaaaaatcacattgggacgcagctgatcggcaaggtccagcgcattggtgtaggtggtggcctggccactcacctccatccgaggcttcctcgcattgatcaagtcatgaagccccataagaacgaggggacggcaatcgatcagcatcacgcgtatcgtttttgtatggtctggcatgatcttcctgcctccccttgaaaaacgatgaccttcatacgcgttggccttccttgatcggccactcgctcttgaaggacggatgcgagcgccgacaggctctgaaagtgcccgcccgggtcttggcgacccggggtacaggcagatattgcggaggtttcccgaagcccggcaaagctattgagaccgcataaataagaataactatcaatagtttgcatgtgctgcagggcatccgcgagccctcaactgagtctaggccagcccactgtgctgcctgccaacccatccgtcggtcttcgactcaggccgggtgcgggtcacgtggtcgatgctccccccaggcgccctgccccccgcaaatcaaggtcttaggctcgctgcgcaggacctgcgggcagagtcggatccaaccaggctcgtcaattaacagacgagtggcgcgcggataagtcagtgctcatcaggacagtcaatttattgacaaaaccggcaatgccatgaaaccagcggctcgacgccgatcccccacagaagcgattggccagccgggacacaactgtcccggtgtctactcctggtcctcgataccaacgcccatggcctggccggcgctaccgggactgagccaggcattcacattctcgacactttccaccggcggtttgcccgcccagcgattgagggtgaagacgttgctgaggaactcgtattgcgtcttgagcaggtcgcgccgggcacgaaactcgttgcgcacgctggtcagtacatcgacggcgttgaccatgccgtagctcagccccttctccgccgccacccgggacagctgggccgaggccagggccgaacggctggcgtcgatcttctcgccgttcgaattggcggtcaggtaggcgctggtgatctccttgaccacccggcgccggatcgcttccaactgctgctcggcgaccagctggtcctggtagagcccacggacccgcgccgaggtcgagccgccgctgtacagcggcacctggacgccgataccggcgacatagctgtcggtgcggggcgtcagggtattgttgtagccctcgttggtctgctgcgcgctgaggttcaggctcaccgtcggatagtgcccgcccttgccactgcgcaacgctgcgttcgcggcttcggcaccgctctcgctggccttgagcgtcgggttcagttccatgccatcgcgcacccaggactccaggctctgcgccgaaacccgcagttgcgcgtcgttgcgaatccggttgagtttctccttgaccggccggccgacgagctccgccaacgcctcgcgactgatgcgggcctggttgcgggcatccagttcctgggccgcgagcaagtccacccgggccttgaggtcgagctggtcggtaatcatcgccagctgcttttcgtacaacgcgttgacccggtccaggctcttttgcgtggtccggcgctcggccctcaccagctccagctcatcctcggccgccagcgcggtgaagtaacgccgcgccagttccaccgtggcctcggcctgggcgtccagcgcttcggattcggactgcttggccaggctcttgaacttctgatagttctcccacgcggccttgttgtagaggtactggcgcagcaccaggctgtagctttcgctatcgtagctgcgctcctgtatcaggtcgttttcctggtggatccggtttctcccggcattcagcgacagttgcggcaacagcgcccccagcgcctcgcgttgatgctccttgccggcctgcgcttgggcaaaagaggccaggacctgtggatcttccagccgcgcctcgcgatacaactgcatgaggtcggtggaataggtcgaggcgctgaccccggtcgacgttaccgcagcggtttgcgccaaggcggcccccgctgccagcatgaatgcactccctagcagaactgacgactctcccacagtcactcctcgatcattgattgagacatcacatcccgggccggctgcatcaggtactgcaacagcgtgcgttgcccggtgacgatcaacacgtccgccggcatccccggcaacaacttgcgctcacccaaggtgcgcaccccgtgctcggtgacccggacccgcgccaggtaataggcggtcccggtcttttcgttggtcaggcggtcggccgagacgctgctgacctcgccttcgatcaccggcgtggtcgagctcttgaacgcgccgaaacggatatcggcacgcttgccgatggcaatgcggtcgatgtccaccggcgccacctgggcctctatgatcagttccgagaccgacggcacgatgtccagcaagggcgtcgccgaacgcacgacaccgccgatggtgtgcacggtcatgccgatcaccatgcccgcgtcgggggcgcggatgacgatccggctgaggcggtcttccagggccgagttcttctcttgcaggtcgtagatcttggtctgcacctcggccagctgcttggccacgtcggaattgaaatccttgtcgacctggaggatctgcaactgcgtttcgttgatctgcaggcgggtcttgtcgatggtggaacggtgatcggccacctccgacctgagcatccccagcttgcggtcctgctcgagcaggcgttgcttgtcgacgaacccctgcttgagcaggtcggacaattcgccgatttcaccgctgtaggatttctccaggcgcaccttgaccgcgatcatcgattccaggcccttgatctgctggtgcaattggccgatgcgctcgcgcagcaccgcgatctggcccagccgcgagccccgccgcgcgttgaatacctgggtctcgccctggcgcgcttcctctccccgcacgctggccggatcgctcatcggcccgaagtcgatcgccggcaacccatcgcgctcggcaatcagcctcgactccatggccctggccgcgatcagcaggctttgggtcgcctcatactccgagcgcagctgggcatcgtcgaggatgatcagcggatcgtcgcgcttgacgatgtcgccatcatgggccagcaccgatttgacgatgccgccttccaggtgctggaccgtcttgcggtaagtctgcacggtgaccacccccggcgcgtaggcggcaccgtccaggggcgcgagtgccgcccaggtgccgaacagaccgaaggtcacgccgacaatgcccatgcccaggcggtgggccttgcgatcggacaccggcaggtcggaaaaactttcgatttgacgactaggcataggattcaccgccatcgtccttacgggcatcgatcgacgccacgttggtcaccaccggtaccggcccggcatgtttgggtaccggcggttgctgcccgctgagttcggccagcacttcctcgcgcggcccgtagaggccgaccatcccggctttcatcaccagcaaccggtcgagttgcgacacgatgttggtacggtgggtaatcacgaacagggtcgcgccggtgtgcttgatctgcccgatggcggccgccagggcgcgatcgccgacctcgtcgagattggaattgggttcgtcgagaatgatcagccgcgggttgccgtacagcgcgcgggccagcccgatgcgttggcgctgccctgccgagagcatgaagccttcgctgccgatgacggtgtcgtagccatcgggcaacagcaggatcatttcgtggacgccagcgatcctggcggcctggatgaccttcgccgaatcgatctcggcgaagcgggcaatgttctcgccgatgctgccctcgaacaattcgatgtcctggggcaggtaaccgatatacgggccaagctcatgcttgtcccaggtgctgatgtccgcgccatccagccggaccaccccatgctgcggcggccagacgccgatcagcgccctggccagggtcgacttgcccgaggcgctcgggccgatgatgcccaccacgcaaccggccggtacgctgaaactgatgttcttgaggatcggggtactcgagccaggtgccgtgacaatcaggttctcgacctgcacctggccctcaggcgccggcaaggacaggcgctcgggttgcgcctgttgcttgccgaggatgtcgttcaggcggttgtactgcgaacgggcggcgataaagcccttccagctgccgatcatcagatcgatgggcgccagtgcccggcccagcagcacggccccagcgaacaccaggccggcccctacctgatggtccaccgccaggtaggcccccaggcccagcaccagcgattgcaccagcaggcggaaagtccgcgaaagcgtggtgaccatgcctccccggtcgctcgccagggattgcagcagcagaacgtttctctgccggcgcccccagcgatccatcagggtgtccagcatgcccatggactcgatgacttcggcgttgcgcaggttcttggtggtatggagggtcgcgccgatatgctccttgttggcctgggccagtaccggccccgtgagcttctcgttgacgaaggcgagcactatcaacagcagcgcgctgcctgtcgcgacccagccgaaccaggggtggaacaggaacatcacggcgatatagatcggcaaccagggcgcgtcgaaaaaggcgaacagaccgctgctggaaagaaactggcgcaagcccgtcaggtcgttgagcgactgggccgaggcatccatgccgccgctgtccagggcccgtttgaaactggccttgtagacctggcgactgagcagcacatccagccgggtactgacccggaccatgatgcgcgaacgaacccattccagggagccgagggtgatcaccagcagggtcatgatcagcgtcaacatggccagggtggtcaggctgccgctggtcatcacccgtccatacacctggagcatgtagaaggtcgggaccagcatcagcgcattgatgaagaaactgaaaaagccgacgaaaacaaagctgtctctacagaccttcaacgcatttttcagactgttttctggtgtgctttgcattgaaacctctgctcgaaaggccagcctttgtggagcttagatcacgccggacagctgcgtgcggccattggccggatcgcctcggacaaccggcatgcccccggcaacggcctggcgcgcaagcacgcgcaagagcctcgcgacttggaaaccagagggctctggcacgggcttttggcgccatagtgggcggatgggaggtggctgctgcagggacgccgagggatgccgggacaggcctcccaggcgcgcgacaggttcgccgcacacctgcttcgcacagaagaatccgattgtcggtagcgacaggtgcagtacacgctgcgccggggtatcccgatgagtctagttactgaattggccggccgatcttgcgatgaccagcggtgcactcgcggatatcgggtaggcgggactgatgatcggcatagacaggatcccgccccccttttcccgcatcaggctttcgagcaggcaggcggtgcccagtcccccatgtcggggttgctgcacacgtcgttcaccatggtctggccacgggcagcgattttctggccttccgcacgcttggccgtggcttgctgcaaggtgcgctcggtggtgacggcttccttgggcacatccgtcttcgtcgttgtcttggcgccggccttcttgcgggtcgccgccttcttgtcggtggcggccggaggcttcacggcggccacctgagcaacgtcctggcgttgcacaccgaccgtctgcaggtctttctcataggcttgggtgtagacatcgatgctctcgccggcacgcccatccacggcggccatcagctcgttggtttccttcaggccgctgacgatctcggccagacgcaggcgcccttcgctgtcgctgatcttcttcgccttgcgcgcattgagcagtgaggtgaactcacgctggtagcagttctgcgcggtgcgggtgtagctgatgctgcggtcgatttcgccggtactctggccgatgtcgctggcgtaggaagcaatgcgcgcacggtcgtcgctgatctgcttctggcgttcgctgtagtagccggtcgcgcccccgaccagggccccggcggcggcgcctatcagggcattgcggccggcatcgccgctattgccgaccagggccccggtcaggccgccgagcaggccaccggcaatggcgccggtggccaccgacttggtcatcgacttgtcggaactgcgcagctggctgaccggctcatagcattgcgggtagtactcgaccttggtttgggccgcgaccttcgagcttggagccccgaagcccgcgcaaccgcccagcagcacagcgcagcagaccgcggtaggcaacggcagggtacgagcaagggtcgaagcgcagttcttgagtgaagtatccatggtgatgtctctcctttttgtgcgtatcaattgcgtttcggcttacgcgcagagtgagcgctgtccgacgtgagcgaagcctgccgacgctacatccagcctagcgggtcttcgccgccaccgacgaccgttccgacaccctgctcagggtccaagaagatctttcaggatcgtctccggatcggctcggtgctgctggcgaaactgccccacgtgcctgacgaaaagcgtggcacgggccatgaggctttttcccagcaccggtttgtgattgagctcttcccgggtccgctggaactgcgtctggatcacctcgtcggtgtagcgcgttccggtcgccaggttgtcgatgtagatcgccagggcgccctcgagcgcactgcgcccattggcgatggccgtttcatagagcttggcggtggcttcgtcctgggcggcccgcgcctgatcgcgatccttcttcaggttggtcaggcgaatgttgtagttgttgaccgtctcggccaccagggccgccgactggatcaggttgcctgcggcctcctcgcgctgccgggcgatcagcgacacattgcgcttgagctcttcgttcacccgcgccaggcgcgcctgcaggttcggatcggtgctgctggcgatgagactgtccagtaactgggtcgggtcttcggcagcctcgatttcatcggtcaggcccgccaggcggccttccttctgccactgctcgaacagttcctcataacgtgagcgcggtgccgacaacgcgcccagggccacccggaaaccggtggtggcgttgcgctgttcgctgccgtcggcggcgaacagcgggtattcgcggcgcatgccggtgaacagcgtcagctcgccttccaggtagttgccgcccttgaccacaaagccgccgtaactgccctggcggcgaccggcgtggaccagttggaaggactcctggaccatctccgcggcgttgccgatcacgtcgaacagtcccaatggattgggctttttcagcccgaccggcaacagccgcgcgccctgccccgtgcccccggcgacctggctgaacaccgcccagtcccctagcgggccatcgctgtcgctgccttgcaccttgcgcggaaacaagcgcgcctccaatgcctggcggctgaccgcatggccaccgcgggcggcgaattcccactccacttcggtcggcaggcggacgaagcccatcccgccgtcctcggccgctttgccgcggccgctgaccggcaaccggtcgcggtggtgcttgagcaaccaggcgctgtataccgcggcaaagcgttcggcctcgaggcgcgacagcttgatcttgggcaagcgcgcggacatgtcgctcatgggggcgcaggccggtgcctcgccctgccccgtcaaggccgcctcctgggccatgaccagggcgtattggcgctcggtgacctcgtacttgccgacgaaatagaacatcggcttgagcaggctgtcggcctcgctcttgggcagggtcggggcgattctggcttgccagtcggccggcaggtcgtcgaggacgaactgaccgttgatgtagtcgcgccgataaccggagatgaaggattgccggtagcccggatcgtcatcgctgaagggatagccgagattgacctcacggtcgtccagggtgcccttggcgaggacatagacgtagcggaacaccaattcgccttcgcagggcagcggcaggctgaggtcatcgggcagcggtttcggattatccgccggggcgtcctgcgcctgcgcctgcgccgcgccggccagcgccagcatgaccagagccttcagccagactaagcccctcagccagaccagacccttcagacagaccagaaccctaggccagttacacatcgcgcagtccttccgaggcttcgatccgcgccgcgcgccagccaccggaggccgccgccagcaggcagcagagcagcgtcagcagcagggccagcaggtagtggatcggcagcagccggcaggcgaactcccccgtcgccggtgcgaacagccggttcagcccggtttcggccatgccgtacaagccccaggccagcagcaggccgaacaccccggtgtacagcgcctgcagcacgacgaaagcgatcagggcgcctgtcgaaaaacccagcaggcgcaataccgacaaggccctgcgcttgcgctcgacggcggccagggcgctggcggtcatggccgcgaaggccccggccagggccaggctggcgatgacccagaacaccagggtcaggttgtggctgagggagcgcacctgggcgatggcgtcggcctgggtcgcgacctcaagcccgcgcttggcgaaataaagacgcaggcgctccacgccgtccaggtccgcggcgtagagacggaaccccggatacacccgcgccgtgttcgctggtggctcgtacccaggccaggccaagccatcgcggtagtcttcggcggcttccagcagggccaggggcgcgaacaacgcatcgcgctggaaggccgcgagtggcaagaccccctgcacccgcaggcgggtgcgctggtattcctggcgcccgccgacctgacggccgaacgcggcgctcagcacgtcgccgccacggacgccgagtttctccgccgcccgctggctgagcagtatctggtccggcgcatcgggcagcagcgccggcgccaccagcgggtcgcccgcggcggtggggatcatctcgaccgtcaacgcctggccggccgcgtccgggtagaggtcggcggtcgcggcgatctgtcgggtacgcggcacgacgaaggcgacctcgggacgatcggccagttcggcgatggcctgggcgctgaagcgcccgccgcccataggcaccacttcgcgcaccgcggggtcgcgctccaggcgttcggtcagggtggtgaccaggccgaacttgaggccgaacagcaccagcaagggcgcgagcacggcgaccagggccaggaccgcgcaagccgacaggcgcacctcggcgcggtagtcgtgccaggccagcagggccatcagggcaagccgcatcagccacctcccgccagggtcgcggtgaccccgccatccgcgccgcgctgcacctgcaagggatgcagctgcagcccggcgcgccgggccagcgcctcgtcatgggtggcgaccaggatgcacacgccgcgctcctcggcctgggccaccagcagttgcatgacccgttcggcgttcagcgggtccagcgaggcggtgggttcgtccgccagcacgatgctcggcccatgggccagggcccgggcgatgctgacccgctggcgctggcccacggacagtgccgccggcagcttgtgcaactggtcggcgatttccagctgctcggccaggcgcctgaccgtggcatcggccggcaggccgagcagcgcccgcgacaagccgatgttgcgctgcacgtcgagaaaacccagcaacccgcccgtctgcagcacatagcccatgacccggctgcgcagcccggccagcacatcctggcggccgctgcgccagagcccggcgacatccagcatccggtcgtcggcgcggcattcgaagacgccgcccgggtccggcgacaacaccagggccagcaggtccagcagggtactcttgccgctgccgctggggcctaccaacgccaggcgctggcccggtcgcaggtcgagccggggcaccaccaggctgtagcgctgtggtccctcgccgcgggtcttgcgaatatctctgagcttgagcatcagggcagcgtcgccaggggcacgcgatacagtgcatcgcccggctgggcctcgccgaagcggacccagttggcgctgtcgttgtggaaggtctcgtacaggcggatcttcgactccagttcgtcgatgaagtcttgctgctcggccacgctcagggacagccagaggtcctgggtcatggtcagcgatttactgcgatacggcaggccgtccaggtactcgccgaggatgccgccttcgaccaggttgccgccctgcttcaaccgcgtcgggtcgcggctcatgtgggcgctggcgctggcgatttcctggaagaaatccttgggcgaggtctgggtacggcgggccgcgtcgacaatcagtttcagcgactgctgcaggtcgttgagctgcagcttggtcagcagcacgcagacctggaacgccggcagcgaggggttggtcaggtcgtggtcggaggtccaggcggtgatcagctgcggcgcacggaccgccgactggcgaccgagaaagtccatttgcatggcgtagccgatggccgtggccttgctcgcgacgctcggtgccccctgtggcggcggcaggctcggcgcctggttgttgcgcgcctgatgcacctgttcggcgaataccgagccgatctcggcgaccgtatcgccgaagcgaccaacatcgccgcccgccaccggaatgtacaggtcgccgatctgcgggttggcgtcggccgtcaggctgcggtactgctgctcggcgaagtcatggtttttccgacccgcctcggtgcgcaagtgcagcgcatagatcttgacctgtttactgagggcagcttcgcgcacctcggcttcgttcatctgggtgcgccccagcggatcgttcttgcgcagggcgccagcgtcggtgaccagcaggatcagccgcccggcatagggactccagtccgtaccctcgaccgccgccatcacaccggcgaaggcatcttcattgaaggcgtggctggacacctgggcggccttgacctggccagccagctcgaggaagcgctgtggatcgcggccctcctccaggctcaccagggtttgcgccacatattccaggcccggggttttctcgacattgctgcgaaaccccaccaggccgaagctgacgctgtccaggtcgccacggctggcgatcttccggtgcaacgcctgcaccacctggcgcacccggtcgatgtagggctgcatcgacaccgaggtgtcgaccaccagcacgatcgccgtgcggaaggcatcgctggcggccttggccgctcccccggccttgctcaggggcgtattgccagggtcgatggaggccacattgagcagttgcaccggctgaccgtcggcatcgaaactctcgcgggcctcgaaaatcggcagcaggtagaactggtcctgggggatggcgctggccacaggctccagcgcgacgatctgcgggtccacgctgccttcgttctgcgccttgtgcagggccgcgcgggcctgcgccgtgtcagccaggaaccgttcgagggtgcttgcttcgcgcaggaacatgaccggcgaacgaccggagcgctcggtgaatttcagcaccaggctctgcttccagtcgctgacctgctcggccggcaaccagccatcgcgctggccatcgctggcggcgccgacctccagccaggtgccccccgccaccgcctggcgctgatagacatacagcaccgagaacgccggcagcgcggcaccgctgggcgccgccccgggctggccggacacctgtgcgccgggcttgctcagcacgcgctggaacagggttttcttgcccggcatcagcagcggccggtcgccgccatcggcgttcgtcgccaacggcggttgcgctgcgctggccgtcttggcgggcgagccctgctcatcgccagccggcgtttttttggcctcgacctggccgttttgcggctccgccggcggcgccgagcgcagccaccagtagcccccgccagccagggccagtaccccgaccacggccacaccgagcagcgccagcaacggcccgcgcgacccggccggcggctgtgcgccgaggcttgcggcccgttcgggtctgtccgtggcggccggctcgggctctggcgcagcgagcggcggcatatcgagggaaaccggcgtcagcccgcccaggccggtcgtcccggattggccggcggccgccgcggcgggcaacggcaatgggcgcaactgcgtcgcctcggcatcggccggcccggcgggcggcaggttgtccagcgcggcgatcagggcatcggcatcggcaaaacgctcggccgggtccttggccagcagcttgcgcagaatcccctggtaacggccgtgggtcatgggcagttcgggcaacggctcggtcaagtgggccagggccgtggacagcgagtcgctgccggtatagggcagcttgccggtgagtatctcgtagagcaccacccccagggcgtagaggtcggtgcgaccgtcgatctgctggccgcgggcctgctcgggactcatgtagctgggcgtgcccacggcgaaaccggcctgggtgaactgggtgctgtcctccagggacttggcgatgccgaagtccgagagcaccgccgaaccgttggcgcggaacaggatattggccggcttgacgtcccggtgtaccaagccctgggcatgggcataccccagggccagggcgatctggcgcaggtagaccaggccctgctgcgggctgagcccctcggcaatccgctccttcagcgtcccgttcggcaggtactccatggccatgtagtagaagtggccgacattgccgatgtcgtaaatggtcacggtgtgcgggtgggaaagccgcgccagggtcttgccctcgcgcaggaagcgctcgcagaagctgcggtcggcggccagcgcggcggccatgaccttgagcgccaccttgcgctccagcgagcgctgggtcgccaggtagaccgtggccatggcgccctcgcccagctcgcgctcgatcccatagccgggaatgtccatgtccatgctcgagcgttcttcggctgatgcgttttcagtgggcattgacgactaccgccgtgatgttgtcgggagcgccccgggtcagccccaggtgcaccaggctgcggaccacctcataggggctcgcgttgcccagcacctcgcgcagttcagggtcctcgacggtcttggtcagcccgtcgctgcacagcaggaagctgtcgccgggacgcacctccaggtccacggccgagagttccagccggtcctgggtgccgacggcgcgggtgacgatgttggccatgggatgctcccgcgcctcggcctcgctgagcagcctgttgtccagcagatcctggacataactatggtcgtggctgatgacctccagctggccctcgcgcaggcgatacaggcggctgtcgccggcccacaggcaggtggcgctgtcgcctcgggcggccagcagcaccagggtgctgcccatgatgccgaccccgcgctgtgcggtttcctggcgaaccgccgcgttggcctgctccagccccgtccgcaacgcctggacataggccggcaaggagggctcgggcgggatggcgcgcaacgtatcgacgatcaggctgctgacgaaatcgcccgccgtatacccacccatgccgtcggccaccacccagaggccggcttgcaccgcatccaggcaggcgtcctcgttgacctgacgcaccatgccgacatggctgtggctggcggattcgtaatgcgttacggctgacgacatgcccctagctcctgaaattagttcccaaaatcagctcctgaaattagctcccgaaatcgaactgcgcggtttgcgcaagcgccgcgtagccgccctcgcccagcagaaaaccgctgaaatcctgcgccgccggcaacccctggcagcgcagcaggccggcagcgacccggccggagcccttgccccaccagagactcgcgccctcgcaggcgtgctgcatcagcaccgccccgcgcgccgccgcggtcgtggcggcgaaacgcatctgcccctccagccccggcatgcccggcatctgcgtgctacagaccgggcgaccgagggccggcaccgcggcctcgaaggcctcgacagcggcctcgggttccagggtcgagagcaacagggcctcggccgcctcaaaccagtcatccgggccggccaccagcgcgcccagatcggtctcggcctctagctgcagcgctatggtcagcgggaagtagcgcccgacccggtcgacgctgggcatcatcacccccaccgccgcctcgctgccgagcaggcccggcgccacggcaaagcgccacagcgggctgaccaggtaggcatccagccaggccgcccccagcgccgcctggctcgcggccatgccggcggagagccaggcatcccagcgctcgataaaggtcggcgacaggccgcggtggatgaaatccccgcggccggccagcttgccgtagaaacccaggctgctcacaagcgctccggtaggctgaagccggacaacagccggcccttgaacgggttgaacgcgctgctggcgcgcagctcgcaggagatgctggcgctgtcgacgcgcatgcgcagggtgaagcggtccggggcgttgccctgggtcaggtcggactgttccagcaagcgaaaccaggcccagggcccctccagggtcagtcccgaacgaccggcgctggtgggcggcgtgacggacaggcgcaccacccccaggctgttggggctgggccattgcatcgccatcggccggctggggccatggtcgtagctgagctgctggccgtccaggtcgagcaggaactggctgatggaggcatccatggccacgggcttgagctcgaagcgtaccgccggttgggtgcctccggcgcggaagtaggcatcgcgaatggccgcggcgcgttggaaggtttgcagcacgcccgggcctatgccgagtttttccgcggcgcccggctgccagcgccagttgctggtcgaggtgttgacgtaggcttgcaggtacttgcgaaagtagttgtccatcaccccgcccacaccgaagaagttgccgaagtcctccagggtggcctcccgcgaactggagttgaccatggggtaacggccagccagggactggcggtagacattcaccacctcactgatccaggccgcgttcagctgggtgcggatgctgcccatcatgctgctggtggtggcgctgaccaccgagttgaccagcttctgcaccagtggcggctgacgctcggcgccaagtttgacccgcgatgccgtggccaccgcctggttcttcgcctcgcccagcagggcctcgccgctggcgccgctcatggcgctgacctgcacataaagctcattgagctgggccagcagatcgtcgatcggcgcgggcccatccccatggggggtcaccaggctattgagctcggcgaagcgcgcgctgatgggatcgacctgcgaggttgccgacgaatcttcctgggccgcttggccgaccagcgagccgagctgctgcttgagtttgtccacggtgccgtcggcggccttgagcttctcggccagcaggcgatcctcttgttgcaggttggtttccctggccaccgcagcgagcagtttcttcagtggcgagtttggcccggagagcacccgcagcacatcggcggcctgggcgatgccgttgatcgcgacgaagtcgagatcgccgagcagtgtttcccattggttgaggaaatcctggaagtacagggcacgcacctccagggccaggctggcgacatcctggttgtcgttcaatggccggccgagtacccattgttcctcggccagggcgccggactggctgaggctggcgaccatgaacgcctggcggtagccgcggtaggtatagaaaccggataacggatcgctcagcggcttgccgctcttgcgcgtgaacaccagggcggcgtcgcgcccggccgcttcgctgaggcgaaaatccgctacgccctcgggcagcttctggcgtttcacccggctgtagacccgctgcgccacggacatctgttgcaactgccgacgcaggtcggccagcagcgcttcatccagcctcgccggtggtggcttgtgggcgaacagcgcattgagatgctccgccagggccagccgctgctccggggccaggtcgcgcggcaggctgtggtcccagtcgaggttgatccaggtcttgatggcatcggcgtcatagtgctcgacgctggccagcatcaggtagaccttgaggccttcgtagagaaactcggtgttgccgccgctgcgcaactgttcctcgatgcgggtcagcagacgcggcgcgagcaccgcgatcagcagcttgcggtacacgctggcggcttcggcgccgagcatgtcgccctggaacaggccatagccttcggcccaggacagcgaattgtcggcgacatggcgaacggcgttgagcagcggcagcacggccaagacctcgcgctgcgccggactgagcgcttcgacctgccccttgagcggcgccaggcgcgcgtccacctcggcgatataggcctggttggcgcggtagctggcgacccagatggccgtcaccgtcagcaagaccaaggcactggcggcgagtacgccacgattgatccagcgatgccggcgctcgaccttggggttgctgccgaccaggccgcgctcgccgaaggcgacatcgcggaacaagcgggtgatgaagtaactgcggcccgtgccggtctggcgcgccaggtgctggcgatccaggttcatgctttgcgccatgctgccgatcagacggtcgatggggctgccttcctgggtgccgctggtgaagtacagcccgcgcaacagcgcccgctcttcatagggattgggcttgaataccccctcgaggaaggacgacaggttgtgacgcaacgccgcgaactgctggatgaaggcgtagatcagatcgcgtcggttggggtcgcgctcctgttgcaggcgctcgaccaagcgctcggtaagacgcgcctcgagggcggtgaattcctcgtcgaaacgggccagcgggccttgggggctcttgccatcgtccagggcaaaggtgacgccccagacctgcgcgcgctcttccttgctcagcgcgtcgaagaactccatgaaccccggcaccaggtcgaacttggtgagcatcacgtagatcgggaagcgcacacccagctggctatacaactcctgcacccgcgtgcggatggcccgggcatgggcgctgcgctcggcctcgctgcccaatagcaggtcggacaggctgatggcgacgaagacgccatcgatcggccggcgcttgcgctggttcttcaacaggtcgagaaagcccagccaggccgccttgtccaccgccgcatggctgtcctgggtggtgtagcgcccggcggtgtccagcagcaccgcttcgtcggtgaaccaccagtcgcagttgcgcgtaccgccgactccgcggatcgctccactgcccatctgttcggccagcggaaagtgcatcccggaattgaccagcgcggtggtcttgcccgagcccggcgggccgatgatcacgtaccagggcagctcgtaaaggttgcgccgctcgttaccgccgagcttgctgcgcttgagcaattgcagcgcttcgtccatgcgttgcttgagggccgccagctcttcggcggtggcgacgctggccgcatccggcgccaccgccgccaggccctgcatgaccttggcggcgttgcgccgggcctggacgatgcgcaatacccgcaccccgatccaggccaggaacaacaggccgatcagcgcccagcgtacggccgccggggccaggggttcataggccgcgacgatgatcagcggaccgaggaaccagatcaccaggctcagggcgagcaggccaagcagcggcaccacccagcgcaccaggaaattgataaaggccttcactggttgccctccgctagcacggtgatctccacgcgcctgttcctggcgcgtccggcggcgctgtcattggaggcgaccggttccgcgtcgctgcgcccttcggcggtgaagcgctcgggttgcccgctgcgggcggcgaggatctccatcacttgctgcgcgcgatcctgcgacagcttccagttcgaggggtagcgcaaggtggcgatcggtcggttatcgctgtgcccggtgacctgcaccgtgcccttgatctggcgcagggcatcggcgacccgcagcagcaagggctgcaactgctcggaaatgctcgcgctgcccgaggcgaacaactcgtcgccacggatggtcaccaccgagcgatccagcgcatcctccacggcaacgcgctgggccttgatgtcctcggcgaggaagcgcgccaggcgcgggcgttcgatcaacctgggctgctgcggtggacggtcgatggcttgcaccgggatctcgcccagggcgtggatattgcgaaacaccggctcggcgtcggccgccagcttcaggcgcaagccgaacagcagcagcaacagcacggccaggcaaatggctacgccaacccagggcggcaggaactgcgacaagcgatcgcgtaccacgctgaggccccgccaatgcggcgacagctcgcgctcgaactcgccgcgcacgctgcgaatggtcgcgctggtgcgttcgcgcaaggcctccagctggctgcggccgtcattcatgacccggtaacggccctcgaagcccaggcagatacagaggtacagcagctccagaatgtgcaggcgctgctgtgggttctgcagacagtgttcgagcagttggaagactttttcgccgccccaggcttcgttgtgcagggtgatcagcaggctctgcttgccccagtcgctggtactgccccagggggtgctgagtaccgcttcgtccagcgcggtacagagcacataacggctgagcatcacctcatcctgggcgacgccggcgccgcgcgcctgctcctcgaactggcgcaggtaagccagcaactgggcgcgcaggctggccggttgcgggtgagcgagggtgctgcgcaagcgggtcagcaacgccagtatcgggccggccgcccgctccagcgggttgagaccctgggccaggctgctcgccaccggcgcacccggcatcgcaatgtgcggatcggcggcgctggccgcgtccgtcctgggggcagaggcatcgacggagcgcccgccgggccgcggcatgatcagggtacggtcgttgccgcccgtcgagacgccgcctgaagtgccacctgcgccagagttgccgaagggatcatcgatcgggtgcatgacgaactatcctcggatggcccagaaggccaggttcaggcctgggaactggccggcaatgtgaaaggcgaagccccctgagtgggtcaactgtttccagtgttcgctgccacgatccagttcgaaatagcttgaaccggcgtgatagggaatctgccgcggcgccacgggcatggacagcaaggcgatgcccggcaactgcagattgaccaggtcgcggatgtgctccaccgagccgatcttggcctgctgggggaaattcgtgcgcagggtttcggccggcacctcggcccgcaccaccaggacgaagctggccatttccagcaagctcttgtcggccagcatcgccacatgcacgccgtaggatttctcgatgatcggaatcggcgtggcgcgggtatcgatgaccatcgacagcgcttgccgcagatcgtgcatcaccggggcgaaactgctctccaggtcgtcgtgggcataggccgggtagtcgctggggcgacgcccggctgcggaaaaggtggcgaactcccccgccaggcagaccgcctcgcgatagaagtcctgcgggtgcaaggggctcaaccgggccaggtggctgagcaagggctcggcgcgattgaccagttgcagcagcagaaagtcggcgatctccgaggcgccgccggcccccgaggccaccacccgaccggccagggcctcgccgcgctggtgcaacaacccttgcagctcgctgcgaaaggccgccagcacgctggaggcggccacatcgagcagcggcgcaatatagtcgtcgtccagttgcacggcattgtccgcgcgtttttccagcacccgcagcaaaccgaggcaggcatattcgccgaggccgtcgcgctcggtcagcaggcgcagggctttgccgccgatcgccagcgacgcccggctctcgaaggcggcgttgtcatcgcgcacttcccgcacctggctgatgtagcgcgcaccacccggagcttcgccctcccccacggtgtcgcggctgccggcacgcttgagcggcaaacccaggaagacctgcgcatcgcgcagattgtcgttgacgttcagtggcggcggcggcagatcgtcgccgggaatgtcgaaaggcgtgccatcgggtagcaccccgcgcgcgctgacaatcgccaccttgccctggccgagcagggactcgtcgatgcgcagctcggagaacccccagcccccggcgctcaacgggcggcaacggccatcgatcagggcttccatgtagcgatcatgttgctggagatgctgcggccgcagaaacattccttcggaccacaccacacggttattccaggacatggactggcttcctcgacaggactaattcgcaggtttcgtggctgccgcgctgatcgccctggctgtcagggaaaccgtcaatggcgtggtttcattgctcgggatattgatcatctggcgccacacggcgctgtccagttcacggtaggacaccaccaggccgagcaaacggctctgctcgtcgagcgtgcgctccagggtcagctgttgacccggctggaccagcaattcgtcctgcgccaccaggtccgcggacaaggtcgcgccgctggcattcaccagggagaaatagtcggcgcgactgaaagctccaccgctcttcaactcatacaaacgcacccgcacaggggtcgcctggccgcccgccgaaagattcagatcggcagcggcctggatatgcatgacaacgacagtaggagcagggggcggcggcggactcgaagcacaggcagtcagcagtagtactgttgcgaacaacaagaactttggcatgtcgtcctccatgacgtttgttattccaaatcgaaactaccgatcgccaaacaagatcaactcactatttaatagccattagcctttacccaactaaccgagggcgctcagccttttcgcaacttggtattttgttcttcataggcacgactgaattcgcgcccgaacaaatcctcgaaatcatcttcagcctccctggaaatgctcgcatagagttccgtgaacaactcccagtattgcgcttgacgtctcccgggcagcaaagcgccaatagccgaaggttgacttaaacgcgcttccagtaccgctggctgaaaacgctcgagcaggtgtttgatcgaggcttgcacgcccgccatgacggccagttgatgcgctttcaggtcgtcgaagctttccttgatcgcctggtcggccggcatgaaggcctggttgccggaacgcagcaataacagcagcgcctcatcgacattgggggcgaatttgagggggttgttctccaccgggcggatcatggtctgggccatgcggaactcacccttgaggctggcacgggcgcgcagcacctcgatcaaccctgcgaccatatgccggtagctgcggccgatggcctccatttgcgcgcgggtttcgcctctgtcgatacgcaagtgctcgagccccgcgcccctgagaaaggcttccagcccctcctcattgtcgcccccgactgccggcgccagaggggcaaccgcggcccgttgcacggccggttcgggtgcgctgccggccctgttctccgatacctctggcaatggttgcggctgggcctgcgcggtggcttgcacagtggccggcgccaccggcgccgggtgcgcccccagttcggtgaaggggtcccaatccgccggaatcgccggtgccgcgccggtttcgctggccgcaggggcgctcgggcgttgtggctcaggcgggcgaaagtcatggcgttcggacggcacgtggtcggccagggccggtgggggcacggccggggacgcgagaaaatcgaacaggtcgggcttggtgtccaggggcgaaccgcccgcgtggatctgcaccctgccggggggcggcgtcgcggcaccgggaatctcgcccggcgcctggcgcttgatcagcgcatcgaagccggtaaagggatcgctcattccgggtgcgccgttggcgatttgtggcgcgccgttgatctgcaccaggatgtcgtactcgccgacgcgcagcagttcgccgtcgcgcaagggctcgctgttgccgcggtgcatgcgcacgccggcattcaccagctgtacgccattggtgctggtgtcggtcaggtagtaggtgccgtcacgcagttgaatgacgcaatgctggccggacaccaggcgctccgggtctggaagtacccagtcgttctcggggttgcggccgattttcagctcaccgcgatcaagctcgaactccgcgcgttggccgggagtcagcttgtgataactggtgattgtcaaacgcagcggcattggaactccttgtacggtattgctcaataacaacagctcgggcatgccagcgagtgcaaagcgagtatagccccctaaaagattttcgcgccctcaaagttcctgcacttatattcgcttttttcaaataagccctataacaaaagaaactaaaaaaaccgccgccgaccgcctatcttcaaacatcacagtgttccccactggtcggagagtttcttgacaacaattgaactgggctaaaacttcaggtcaattgttgaattcagaaatgacgccaaacagtggctctggatagaacactcatccgcagcaaaagggatttagtcgtgcgctcaccctgaccgggcgccgattgccgggccgatatggagatcacgtccgtggtggatgtacagcgcttgttggaaaccatttcccctgactccccctgtggcggcgacctcgagtacgacgccgcctttctcgagcttgaacgcgcggcgcaaggccaacccgaacggcagatgggcgatgccgtgttacccgccgcaccgccggaatggcgccaggtccgcgacctctgcgtcgaactgttcacgcgcagcaaagacctgcgcatcgccaactacttcctgcaaagcgccattgccctgcaaggcttgcccggcctggtgcaagggctacagctgatccagcagttgctcgcgcagtattgggacgacctgcatcccaagctggatgcagaagataacaatgaccccacctttcggatcaacgccctcgccggcctcaacgccgagccggtcattcgcctgctctggggcatgccgctgatcagctcgcgagcatttggcagcgtcggcctgcgggccgcgctgaatgccgcgggcttgcagcgcttcgccagtgaaagcctcagcccggaccagctcggcgcggcctttcaggactgcgcgggcgaacagctcgaggcctgccgcgccgccctgaacgatgcccatggcacgctgttgagcatagagcgcgaggtcaatgaacgggtcggctccacccacggcgcggacctgggcacgatcaagcaactgcttcggcatgccgtgcaaatcatcgccgagcacgcccctcagccaggcgttcccggcgctgtcgcgcaggccggcgagcctgtcgatgccgccatgtccccggcccccggcgccgccgcgccgcgcatcgccggcgagatcggcagccgtgacgatgtgctgcgcagcctcgaccggatcctcggttattacgccaggcacgagccctcaagccccgtgccggtgctcctgagccgcgccaagagactggtcagcgccgatttcgccaccatcgtgagcaacctgattccggacggcttttcccagttcgaaaaattgcgcgggcccgagggtgaatagtccgagtgaaacgctttaaccgacgcccatccaacacagccgcataggcagcgcaggaggaaaaatggctaacaccagcagccagaaattcatcgcccgtaaccgtgctccccgggtgcagatcgagtacgacgtagagctttacggcgcggagaagaaggtgcaattgcccttcgtcatgggggtgatggccgaccttgtcggcaagcctgccgagccgctgccggcggtggccgaccgcaagttcctggagatcgatgtcgacaacttcgactcgcggctcaaggccatgaaaccgcgggtggcgttcaatgtgcccaatgccctgaccggtgaaggcaacctgagcctggacgtcacgttcgagagcatggacgacttcagccctgccgcggtggcgcgcaaggtcgatgccctcaaccaactgctcgaagcccgcacccagctggccaacctgctgacctacatggacggcaagaccggcgccgaggacatgatcatgaaggcgatcaaggacccggccctgttgcaggcgttggccagtgcgccgaaaccgaccgaacccgagccgcaagcctgacagaggacgcagaccatggccgaattgatgaaagacccgcaggcccaggcagacgccgcgaccgcaccgagcgacttcgccgccttgctcctgcaagagttcaaacccaagaccgagcacgcccgcgaggccgtggaaagcgccgtgcgcactctggccgaacaggccttgagcaagaccgagctgatctccaacgacgcgatcaaatccatcgaatcgatcatcgccgcgatcgatgccaagctcaccgcgcaggtcaacctgatcatgcatcaccccgacttccagcaactggaaagcgcctggcgtggcttgagctacctggtcaacaacacggaaaccgacgagcagctgaagatccgcgtgatgagcatcgccaagggcgacctgcacaagaccctgaagaagttcaagggcaccgcctgggaccagagcccgatcttcaagaaaatgtacgaagaggaatacggccagtttggcggcgaaccgttcggctgcctggtgggcgattactacttcgaccagtcgtcgccggacgtcgaactgctcggcgagctggccaaggtctgcgcggcgatgcatgcgcccttcattagcgctgcctcgccgacggtgatgggcatgggctcctggcaggaactgtccaacccgcgcgacctgaccaagatcttcaccacgccggaatacgctgcctggcgttcgctgcgcgactccgaggactcgcgctacatcggcctgaccatgccgcgtttcctcgcccgcctgccctacggcgccaagaccgacccggtggacgccttcgccttcgaagaggaaaccaacggcgccgacagttccaagtacacctgggccaactcggcctatgccatggcggcgaacatcaaccgctcgttcaagctctacggctggtgctcgcggattcgcggcgtggagtccggcggcgaggtgccgaacctgccgacgcacaccttcccgaccgacgacggtggggtggacatgaagtgcccgaccgaaatcgccatcgccgatcggcgcgaggcggagctggcgaagaacggtttcatgccgctgctgcacaagaagaacaccgacctcgccgccttcatcggcgcccagtcgctgcagaagccggccgagtatgacgaccccgacgccaccgccaacgccaacctagcggcgcgcctgccctacctgttcgccacctgccgcttcgcccattacctgaagtgcatcgttcgcgacaagatcggctcgttcaaggaaaaggacgacatgcagcgctggctgcagaactggattctcaattacgtggacggcgacccggcccactccaccgaaaccaccaaggcgcagcaccccttggccgcggcggaggtggtggtcgaggagatcgagggcaaccccggttactacagctccaagttctacctgcgcccgcactaccagctcgaagggctcacggtatcgctgcggctggtatccaaacttccatccgccaaggcggtttgattcatctcaggaggcattcgccgtggtggcgggtgccctgcgacgcagcgtggcgaatcactggcacacagtggtgcaaaccacttaaggaggcatgatggctgttgatatgtttatcaagatcggcgacgtcaagggcgagtcccaggacaagaaccacaaggaggagatcgacgtgctctcctggagctgggccatggcccagtccggcaacatgcatgtgggcggtggcggcggtgccgggaaggtcaatatccacgacctgacgttgaccaagtgggtggataaatcctcccccaacctgatgatggcctgctccagcggcaagcattacgacgaggccaagctgacggtgcgcaaggccggcggcgacgatccggtcgagtacctgaccatcaccctcaaggaggtcctggtgtcctcgatcggcaccggcggcagcggcggcgcggatcgcctgaccgaaaacatcgcgctgaatttcggccaggtgctggtcgactaccaaccgcagaagcaggacggttccaaggacggcggcccggtcaagtacggctggaatatccgccaaaacgtcaaggtgtgacgccagccaccctgcagccctgccgcagggtgctcggcttgtaccaggggccacggcgcaacaggaggttcgatgatggccagacccgcgttcatcaatctgtggaacaactacccggctgaaagccagccttgcgatggcggttgggaaaatcaatgcgcgatccgcctgagcattacgctcaatgccgagcgaagcatcctcgtggatggccacacctattcggaaccgcgctgcagccacggccacgcccgcggcgccgagtcgctggcgaactggctgtggcgccagcatctgggccggccgagcatctttatcgacgcggccaaggccaagctgcagctcaatgagaagaacgggatcatttttttcaaggattgctttacccgcagcggcgagagtcgcgcggccggcgaccatatcgacctgtggagccgcggtttcaccaagacctacgacgacccggccaaccactccgcccaggtgtggttctgggagctgtcatgagtcagcgcctgcttcgccttatcgtcgcgggcctggcgggtttgatgttgcccgcctgcgcgcagaacccggccgatagcgccacccaggcgcgcttcctggcccgggacctgctgctggaagagcgcaatggcaactgtcgtgtgctggtcccgcagcaacccggcatcgacctgagcctgaaatggccttgccagttccaccgtgaccccagcggcatcctgcgcaccagacaggtggggacgcgccaggtgatattggtggaaagcagcgagcaactaccctcgcccagtcgggattgccgtaccgagatccaggcgctacgcagcggctccgatcagactctggaagcctcgtcggcggtgagccgggtgacggcctgcccgcccttccagtgggatgagaaaatgtttatcggcttgttcgaacccgacgtttgagcgcacgccagggctcggctcgaagcctgcgaactaaacctgcgaataaggagatggcaatggacgccgaacagccgatgtgtgcagatcagttgggcggcgccttccgggccctgcgggatcaactgcacagcctcagcttcaccgacagggataaccgaagatggccgagctgactctgcaagaacgcctgcaaccctcgttgctcgatcgcctgaccgacgacgatccgcacaacccgaaagaagccgccgagcgccgcgtcatgtcgctgacccagctgaaagcttgcgtgctgcgcgatctggcctggctgttcaacacctgcgtgctgttcgatccggagcaggccgcgcagatgccggcgggcaactcggtgctgaatttcggcctgccgcccctggccggacacaccgcctcgagtgtcgatgttcaggccatcgaagccttgttcagcgacaccatcgccacctttgagccgcgcatcctcaaaggctcgttgaaggttcgcgcgcgactcgacggcaatgacatgagccacaacgccctgagtttcgagatcgagggcgatctgtgggccgagccggtgcccctgcgcttgctgctcagcaccgccctcgacctggaaaccgggcacgtcaaggtgacgccggccgagcccgccaggagacgccaatgaacccgcgcatgctcgagtattacaaccaggagctgcagcatatccgcgagagcgccgccgagttcgcccaggagttccccaagattgccagccgcctgaccctgtccggcatcgaatgcgccgacccctatgtcgagcgcctgctggagggcttcgcctacctgagcgcgcgggtccacctgaagctggacgccgaatacccgaccttcacccacaatctgctggaaatcgcctacccccattacctggcgccaacgccttcggtggtggtggtccagctggtcgccgaccctaacgagggttcgctgaccagcggcttcacggtcgaacgccacgctgccctgcgcggccagctgggccatggcgagcagaccgcctgcgaataccgcagcgcccatgccgtgacgctgtggccgttgcaggtcagccatgccgaatacttcggcaacccggccgcgaccctcggccgactggccgccagcgaacccaaggccaaggccgggttgcgcctgcgcctgcgctgcggcgccgggttgccgttcaacgccctggcgctggacagcctgccgctctacctcaacggcgccgacgagcaacctttccgtctgtacgagcagctgctcggcaacgcctgcgcggtgtttatcaagagcgtcgacggcgactgggccgagcgcttgcctctggaaagcctcaaggcgcgcggcttcgacgatcaggacgcggtgctgccggtggtgccccgggccttccaggggtatcgcctgctgcaggaatatttcgccctgcccaatcgttttttgttcgtcgacttcaccgggctgagcgccggtgtgcagcgctgcgccagccaggaactggaggtggtggtgctgttcgatcgcctcgacagcaccctggaaggcacggtatccgcagcccaattcgtgcccttctgcaccccggcggtgaacctgtttgcacgccgcaccgatcgcattcacctgagcgagcgggtgcatgagcaccaggtgatcgccgaccgcacccggccgctggatttcgagatccattccctgacccaggtcaccggccatggcagcggccccgagcagccgttccagccgttctatgcgatccgcgacccgctgcgttatggccgcgagcaggcctactacatcgtccgccgcgagccgcgtcgcctgtccagccagcaacggcgacgcgggccacgctcgacctatatcggcagcgaaaccttcgtctcgctggtggatgtcaaccaggcgccctatcgccacgacttgcgccagctcggcctcagcgccctgtgcaccaaccgcgacctgccgctactgatgccggtgggtaccggcaaaagcgatttcaccctggaagacagcgccccggtgctggccgtgcgctgcctggccgggccaagccggccgcggccgagccgcgcgcacgatgccagcgcctggcggctgatcagccagctgtcgctgaactacctgtcgctgagcgaacagggccagggggccgcggcgctgcgcgaattgctgcgcctgtacggcgaccccggcgatgcggcgctgcagttgcaaatcgagggcctgcgtcaggtgcgcagcacgccctgcacccgccgcttgccgatgccggggccgatcgtttttggccgtggcctggagatcagcctggagttcgacgaaaacgccttccgcggcaccggcgtgtacctgctgggcgcggtgttcgagcgtttcctggcccgttacgtgtcgatcaacagcttcaccgaaaccgtgctgcgcaccaccgagcgcggcgaaatcatgcgatggcaggcgcaccccggatgtcgaccgaacctctgaaaccgctgcacagcatcgagcggatggccgacgagccctgggcctacgacttcttccaggcgctacggcgcatcgagtgcgaggccagcgaccggccgcgcatcggccattccctgcgcttgcacgacgacccgctgcgcctggggcagaaacccgactgcggcttcgccccctcgaccctggccagcatcgagaccggccccgagggcgccgcgccgcgcatcgagcagttgttcttcggcctcaccgggcccaacggcccgctgccgctgcacctgaccgaatacgcccgcgatcgccagcgcaacaacgacgacgccagcttcacgcgctttctcgacgtgttcaatcaccgcctgttatgcctgttctaccgcgcctgggccgaagcgcggccgaccgtcagccatgaccgccccgcccacgactactggtcgatgcgcctggccgcgctgtccgggcggggcatgaccagcctgctcggccagggcccgatcgccgactcggcgcgttaccacttcaccggccacctggcggcgcaaacccgctacccggacggcttgcgcgccatcctggaagactatttcggcgtgccggtcagcatcgaggaatacgtcggccagtggctggagctgccgcagcgcagccagctgggcgtggcgctctgctcgctcggcagcgacctgagcctgggcacccacgtctgggatcgccagcataaattccgcatccgcctggggcctttgagcctggagcaataccgccgcctgctgcccggccaggaaagcttcggcgaactggccgcctgggtcgccgagtaccagggcgaggagctggattgggaagtcaatctgctgctgcggcaccaggaagtgccgcgcatcgatctcgacggccagacccgcctgggcttcgacacctggctcggcagcccgtcgacggatgccggcgacctgctgctggcccgcgaatacgccagccataccaccccctcaaggagcagcgatcatgagtgagatcagccgcgccgcgctgttcggcaagttgaacagcccggcctacaaggccatcgaagccgccacggtgttctgcaaactgcgcggcaacccctatgtggagctggtgcattggctgcatcagttcctgcaattgcaggacggcgatttgcaccgcctggtccgccagttcagcctcgacccggcgcgcctgtccagggatatcaccgacgccctggaccgcctgccgcgcggctcgacctcgatcaccgacttgtccttgcaggtcgaggaagccgcggagcgcggctgggtctatggcagtttgctgttcggcgagagccaggtgcgcggcgcctacttggtcgtcggcatgctcaagacaccgagcctgcgccacgccctctcggccatctcccgcgagttcgacaagatcaaggtggagcacctgatcgagcgcttcgacgaatacctcggcgactcgccggaaaacggcctggccgccagcgacggtttcaacgccaccgccgcgccgggcgaagcgagcggtgccctggcgcccagcgcgctgggcaagcaagaggcgctcaagcgctttactgtggacctcaccgaacaggcccgcagcggcaagctcgaccccatagtcgggcgcgacgaggagattcgccaactggtcgacatcctcatgcgccgccggcagaacaacccgatcctcaccggcgaagccggggtcggcaagaccgcggtggtcgagggcttcgccctgcgtattgtcgccggcgacgtgccgccgagcctcaaggacgtcgaactgcgcaccctggacgtcggcctgctgcaagccggcgcgagcatgaagggcgagttcgaacagcgcctgcgccaggtcatcgaggatgtgcaggcctcgcccaagccgatcatcctgtttatcgacgaggcccataccctggtcggcgccggcggcgcggccggtaccggcgatgccgccaacctgctcaagccggccctggcccgtggcaccctgcgcaccgtggcggcaaccacctgggccgaatacaaaaagcacatcgagaaggacccggccctgacccggcgcttccaggtggtgcaggtcgacgagccgtccgaggccaaggcgatcctgatgatgcgcggcgtcgcctcgaccatggagcagcaccacaaggtgcagatcctcgacgaggcgctggaggcctcggtcaagctgtcgcaccgttatattccggcccggcagctgccggacaaatcggtaagcctgctcgataccgcctgcgcgcgggtcgccatcagcctgcatgcagtaccggcgcaagtggacgacagccgccgacgcatcgaggcgctgagcaccgagcaggcgatcatcggccgcgagcaggccattggcattgccattggcactcgccagcaggaggtcgaggcggccctcgccgaggaacgccaacgcctggcgaccctggaaggtcgctggagcgaagagaaagccctggtcgatgaactgctggcgacccgcgccaccctgcgcgccgccgccgaaccgctggacgacaccagcggcgaggccgacgctgcatcgccgcgcctgggtgaagccgaacgcacggcattgcgcgacaagctcggcgacctgcagagccacctcgccaccttgcagggcgaaagcccgttgatcctgcccaccgtggattaccaggcggtggccgcggtggtcgccgactggaccggcatcccggtcggacgcatggcgcgcaacgaaatcgacaccgtgctcaggctcgacgagcacatgaaaaaacgcatcatcggccaggaccatgccctggcgatgatcgccaagcgcatccagacctcgcgcgccgggctggacaaccccagcaaaccgattggcgtgttcctcctcgccggcacctcgggcgtgggcaagaccgaaaccgccctggccctggccgaggccctgtacggcggcgagcagaacatcatcaccatcaacatgagcgagttccaggaggcgcacaccgtctccaccctcaagggcgccccgcccggctatgtcggttacggcgaaggcggcgtgctgaccgaggcggtgcggcgcaaaccctacagcgtggtgttgctggacgaggtggagaaggcccacccggacgtgcacgaaatcttcttccaggtgttcgacaagggggtgatggaggacggcgaaggccgcctgatcgatttcaagaactgcctgatcctgctcaccaccaatgccggcaccgagatgatcgccagcctgtgccgcgacccgcaacggctgcccgatcccgatgccatcgccaaggcgctgcgcgagccattgctccaggtgttcccgccggccctgctcgggcgcctggtgaccgtcccctactacccgctgagcgacgagatgctcaaggccatcacccgcctgcaactggagcggatcaagcagcgcgtggaaagcgggcacaaggtgcccttcgcctacgacgacagcgtggtcgacctgatcgtctcgcgctgcaccgagatcgagagcggcggacggatgatcgacgccatcctgaccaataccctgttgccggatatgagccgggagtttctcacccgcatgctcgagggcaagccgctggcgggcgtgcgcatcagccaacgggacaatgcgctgcattacgcattcgacccgcatgttggcgagacgaccgactgacgcccgaacgcgagccggaggaagccgtttatggcaatcacgcaaagcacccgcctggtgcaggtcgacagccccctcggcggcgaggtcctgctgctgcagggcatggaaggcagcgaggagctggggcgattgttccattacgaactggacctcacctccgaagaccgggcgatcaagttcgaccagttgctgggcaagccgatgggcctgaccctggagctgcacggcggcggcaaacgctatttccacggtattgcctgcggctgccggcaactgaccggccacggccagttcgccggttatcgggtcagcctgcggccctggttctggctgctcacgcgcacctcggactgccggattttccagaacaagacggtgccggacatcatcaagcaggtgttccgcgacctcggcttctccgatttcgaagacaacctgagcggcagttaccgcgagtgggaatactgcgtgcaataccgcgaaaccagcttcgatttcatcagccggctgatggagcaggaaggcatctactactacttccgccatgagaaagcgcggcatgtcctggtgttggccgacgcctacggcgcccactcgacggtggccgactacgcctcggtgcccttctacccgcccgaccagcagatgcgcgagcgcgaccacttctacgactggcaactggcgcgggaagtccagccgggctcgctggcgttgaacgactacgacttccagcgccccggcgccagcctcgaagtgcgctccagcgtgtcgcgcagccacagcaacggcgaccatccgctctacgactacccgggcgagtacgtccagagcaaggatggcgagcattacgcacgcacccgtatccaggccattcacagccagttcgagcgcgtgcagttgcgcggtcgtgcgcgtggcctgggctgcgggcatctgttcaagctgaccggctacgagcgcgccgaccagaatcgcgaatacctggtggtggtcgcacgctatcagatccgccaggagctttatgaaagcgggcaactggacctggccgagcagttcaccagcgagctggactgcatggatgccagccaggccttccgccccctgcccctgacccccctgccgattgtccgcgggccgcagaccgccagggtggtaggccccgccggcgaggagatctggaccgaccagtatggccggatcaaggtgcatttctattgggatcgccacgaccaatccaacgaaaacagctcctgctggatgcgcgtgtcgcaggcctgggccggcaagaactgggggtcggtgcagatcccgcggatcggccaggaagtgatagtcggtttcctcgaaggcgacccggatcgcccgatcatcaccggccgcgtctataacgccgaacagaccgtgccctacgaactgccggccaatgccacccagagcggggtgaaaagccgctcgagcaaggagggctcgcccgccaacttcaatgaaatccgcatggaggacaaaaagggcgcggagcagttgttcatccacgccgagaagaaccaggacatcgaggtcgagaacgacgagacccactgggtcggccacgaccgcagcaagaccatcgacaacgacgaaaccgtgcacgtcaaacacgaccgcaccgaaaccgtcgataacaacgaaaccatcaccatcggcgtggaccgcaaggaaaaggtcggcaataacgagaccatctccatcggtgtgaaccgcaccgaggatgtcggcagcgacgagaaaatcaccatcggcgccaaccgcaccgagaaggtgggcaacaacgagaccatcaccataggcgcggaccgcacggaaaaggtcggtgccaacgaaaccatcagcatcgtcagcaaccgcaccgaggacgtgggcggcaacgagaccatcgacatcaccggcaaccgcaacgaaacggtcaagggcaacgaaggtatcgagatcaacggcaaccagagcacccagatcggccagaacgaatcccgcgacgtatcccagaaccgcaccaccaacatccagcagaacgacagcctggacgtcggcaagaacttctccctcaccgccggcgattccatcaccctgaccacaggcgcggccagcatcaccatgaagaaggacggcaccatcatgattcgcggcaaggacatcaccatcgacggctccggcgccatcaacatcaaggccaacaggaacgtggtggtcaagggccagaagatcctgcagaactagcacaatggaggcatgcaatgacggttcaacacccgctacccatgcaagcccgcatcgacgctgtcgtcatcggcaccctgctcgagctgccgcacgccagcgcgcccagggtcgtttacccgggttgcccggatgccagcggcgtcgtggcccgctgcaccgcgctgctcggccccgcggatatcggcggccaggtcgcgttgatgttcgaaggcggcgacccggcctgcccattggtgatcggccgcttgctcggcacggatgccccgcccgagcccgtcgccagcgtgcggctggacgagcattgcctggaactgagcgccgaacgcgagatcgtcctgcgttgcggcaaggccagcatcaccctgacccgcgcgggcaaggtgatcatccagggcgcctacctgtccagccgctccagcggggtcaaccgcatcaagggcggttcggtgcagatcaactagacaggtatccggcctatggaactgctcaacgccagccaactgcttgcggcctatacccagggcctggcgcccgatggccgcgaatccctggtggtggtggccaagggcacgttcaacctgcccctggacggccgcgcggccaccctcgccgacacccagcaaccgctgctgatggccgacacttttctcggcgagcccggtctcagcgcgccgctgcaggaaatggacttcgccccggtcaagccatgctgcgatgtcctggtccgcggcaaggcctacgccccaggcgggcgccccgtgacgcagctgaccgcgggcattcgcgtcgggcagatgagcaaggctttttccgtcctcggtccacggcaatggcaatcggggctgttgggcgttgctcccggtttgccgcagccgtttaccgagcaggacatctcctacgcccgggcgtttggcggcagccatccgatcgccaacgacccccaattgcgccactgctacctggacaatccgaccggttgtggctggtacccgcgcagcgctgacagtgccgacatcgtcggcataccgatgccgagcaccgaggagctgggcaaaccgatcgacagtccctctggcaactttcgccccatggccctcggccccctcggccgtggctggccacaacgcgcccgcttcgccggcacctacgacgaggcctggctggccgactgctttccctttctgccggcggatttcgaccaccgctactttcaggccgcccccgacgatcaacagacccactacctgcgcggtggcgaggatgtgctgttgctcaacctcacgccccaggagcgcgcgggctttcgcattccccagatggaggtgccggtgaccttcttcctgaaaaaaggcggccatgaaaccgtgcaagcggtgatcgacaccctgctgatcgacaccgacacgtgccaggtgcagttgacctggcgtgtctcccgtccgctacaacgcaacatgttcgagatcgctcaggtgctggtcggcactatgtccacgggatggtggcgcgcccgcgaactgggcaaggattactacccgtcgctgtcggccctggtaaaagccaaacgcacgcccgaggagacgccctgatggccgcgctgtgcatcatcggctccggcatggtcagcgccgttggccttagcgcccccgcgagctgcgcggcgatccgttgcgccatcgacaacttccaggaaacccgtttcattgaccaggcaggggaatggttgatcggcgcgcccgtgatcctgcctgagccgtcctccggatatgcacaactggtgggaatggccagcatggccatcgcagagtgcctgtccggtctgtccgacgaggacgtccacgacataccgctgctgctcggcgtggccgagagcgatcggccaggacgcctggagcgcctggacgagtccttgctgcaggccatcgaggagcgcctcggtcagcgctttcacgagcgctcctgtgtgatcccgcggggccgggtgagcgccgcggtggcattgatcaacgcacgtagactcatcgagcagggatgttcgaaggtactgatcgcaggtgtcgattcctatctcaccggggcgacgctcgcggcctatcaggagcgagaccggctactcagcagtcattgcgacaacggcttcattcctggcgaaggagctgcggcgatactggtgacggccgtgcgggccagcgaagagccgcaactgttatgccttgggcttggtttcggaagggaaaaagctactgtcgaaagcgaggggctgccatttcgcgcggacgggctcactcaggcggtgaaagcggcgttcgatgactgcggcttcggcttcgagcatatcgactatcgtctcgccgacctgacgggtgagcagtattacttcaaggaagccgcgctggccctgagccggaccctgcgggtacacaaggagcgcgtcgagctctggagccccgcggactgcatcggcgagtgcggggcaatgaccggacccgcgctgctgtgcattgccctggctgcctcgcgcaaaggctacggccacagcgcgcaggtactctgccattcgagcaatgatgggggcgagcgggcggcgatggtgctcggctaccagcatgtgagggcgaactagatggccaatgaggtctacgccaatggtcgagaactttcctgcaagtcggcctcggggaaatcgatagcctcgtttcccgacgtctgcttcaccccgccacaggcaccgcctacccccttgggcgtaccgatcccctatccgaataccggcatgtcgaaggacacgacgcagggcactcggaccgtcaagatcaccggcaaggaagtgatgctcaagaataagagccatttcaagaagagctatggcgacgaggcaggtcgagcgccgaagaaaggcattatcaccagtaccaataccgggaaggtctatttcatctcctggtcgatggatgtgaagttcgaaggattgaacgtcgttcgccatctcgacctgaccacccacaaccacaatccgtctcctggcaacacggcaacctggccgcacacctcaaagatgaaggcggccttcaagccgggcggcaagtgcgccggcatgggacacctgcgcctgcagccctatagcaaggcctgtccgaacacagcgagcggagcggcgcaaaccggccaccatctgatacccggccgctgcatgcgcggcaaggccggttacagtcactcgaaagccccggtgatctgcgtgtcgcgcggcaaccagcaccagggttcgcacaagcgctgccatgcgaagttcgatccggtcgaattggaccacttcgacaagggcaagccgttcaaatacgaaaccgcacgcaacactgcggccgcctcggcgggaggcgcgctgagccccccgcgcgacctgacgaaaaaagagcaggagtgcgtcgccttccagctcgaccagtactacaaggccaagccgaagaaaggacctggctgcaccaacactttgaacctccgtgcctcgggcgcggcgggcaaagtcataccacccgcacgttccgcaccagcccccgcaggacgcccataggatctgaaccatggcaaagagcgaaaccgccctctacttcaccaacattatcgcgatcggaccggagcaggcgctgctcggcgggcatctctatctggagggcgcggaacccagcgtaacccgggtgatgatgatcgaccaggacgactggttccatgtctacgacattcccgaggtggtctacagcgctctgcagagagcaccgctgcgcgggcagcagaaaggtaactactgtttcctcgggcgggccgggctactccgtgaacacccctccgggcagtccagcaccgacaccatgctggacatcgacaatgtctacctgatggacctctgcgaggtggatggcgaactgtatgcctgcggcacacagaaccaggtattgaggcaaagcaagggcgtctggcagcgcatcgaccaggggctctatgttccgttggtggacgaggtcacggcctgcctgaacggcattgacgggttctcgcgcgccgatgtctatgccgtcggcgatggcggcgccatctggcactgggacggcaatggctggcaggcatcggtggcccctaccaacctgccgctttactgcgtgcactgcgccgccgatggtgtggtgtacatcggcgggtccggcgggatcctgctacgaggcagcgcgcaggcgggatggacagatatcggcgatcgcgacctgtgcgccgaagtgctggaaaacatggttgagttcgccggcaagctctacgtgaccgcaaccgaccagttgctcgagtacgacggcgtgcagctgcgcgagaccaaggtgccgctgaggggcaaaaaggcctactacgccatcgatgccaagcccgatgtgctgtgggtggcaggcgacgaatgcgtgctcagtttcgacggcagcacgtggcggcgtcatgtttgcccagaaaactgatcgatgacgagcctcagtatcgtcatcgaccagcatattgaggaggccacctttctggccggtctgcgcgaccttgccgtgcacgccccccactacgacctggcgcacctgctcgatctcgacaagcgcatcgaagctcatctggatgctttgcagataggcgggctaaagagcctggacctggtgctccagcagctcaaccccaacgcccagggcgagatattcgcggccacggtgctggccttcgaagccgccaatacttgcgcaatgacccagttggccgaacatctgcgcgcccaccccgacggtgcccgttatatgggtgccgcgctgggctggctggactggccccgagtcgaaccctgggtggagaagctgctcggctcgccgcaagcgttgtttcgctgcatcggcctggccgcctgcggcatgcaccggcgtgatccgggggcagtgttgattgcggggttggcgcatgccgatgtggccgttatcgcccaggccgctcgtactgccggcgagttgcgccgtcgtgacctgatgtcggcgattcgtgcccaccgccagcatcaagacgcagccacccgcttctgggccaactgggccaccgcgcagatgggcgacgaggaagctttggagccactgcgccagttcgccgagcaaccgggcgaattccagtaccgcgcgctctgcgtatggctcgcctggcaacagcgcgagtacagcatcgcctggatccgccagttgatgcagaaccccgggcagcggcgcatcggcatccaggccgtcgggctgctgggcgatccggtcagcgtgccctggctgatccagcagatgagcgacctgccgcatgcccgcgtcgctggcgaggccttcagcctgatgactggcgccgacctggcgctgctcgatctggaattgcaggacctgccggatttcgatgccggcccgaacgacgactctgaggatgccaatgtcgtcatggatcccgatgagaacctgccctggcccgacccgcggttgatcgcagcctggtggcaagcccatgcaggcgatttccaggcaggcgtgggctatgtgctggggctgcaacagagcgaaagcagttatctgcaagcgcttgtccgcggccagcaacgccagcgaatcgccgcggcctgctgcatcgcgcgcttgcgaccgaccgaggtgctgttccccaccagcgcacccgcctggcggcaaaaggcattgttgggagagccggtggcgttcgggcgctgagccggcaaccgccccggatggcaccgggctacaccggacagcccccgctaacgccagcgcattctccccgcgccttatcgcgcgaccgaagccacgccgcgattcagctgttcgcgcaggaactcgataaacacctgcaccggccgcgaaccctggcggtgctgcgggtagaccgccgacaaggccaggggctcgggctcgaagccgtccagcaccgataccagccgcccgtccttgagcgcggcctcgacgatgaaggtcggcaggtaggtaatgcccatgccggcgatggccgcgtccttgagcaattcgccgttgttgacccgcatcctgccggtgacgttaaccagcaagggcttgtggccctgcccttcgaaacgccactgcacctggcggccgtggccgtaaggcaggcagtcgtggccttgcagttcctcgggcctgagcggggtcccgcgctcggccaggtacgccgggctggcgcaatacacccgctggatcgaggcgatgcgccgggctatcagcgtcgagtcttccagcacgccgatgcgcaaggccaggtcgtagccctcgccgagcaagtccaccggccggtcgctgagatcgacttcgaccgtgacgtcgcgatagcgccgcaggaacagcggcaacagctcccccagatgggccatggcgaacgacagcggcgcgctcaggcgaatggtgccccggggttcgacggtctgcccggcgatgccctgctccacctgttcgacttcgctgagcaggcgcagggccgactcgtagtagctctggcccaggggcgtcacgtccaggcgccgggtcgagcgattgagcaggcgcacgcccaggcgctcttccagctgcatcaggcgccggctgacgaactgcttggacaggcccagctgatccgccgccgcggtgaagctgccggcgtccatgacctggcaaaaaatacgcatgtcttcgaaggggttcattgtcactctctggttgacagctgaacgctttatagcgattttttcgcgttccggcacctcattccacctggaaaaccacatcgcctggttttacgacggctgcgccgccgatcgcagcctgcggcagcggctacagggaccgcgatgcctgtgtagccctgccgagcttgcgaggctgcgaacggcaacgcagttgccgcaaaacctgagtccgcgatctgctggaaaaccacatcgcctggttttacgccggctacgccgccgatcgcagcctgcggcagcggctacagggaccgcgctgtccgcgaggcaaaaaaatgcccgcacaatggcgggcattttttcagctcagcgatgacgcgaagcttatttggcagtgaacgccgagtagctgttcatcaggttgcggtagttcgggatacgctgcgacagcaggttggccaggccttccatgtcgttgcgccagtcgcgctgcagctcgcacgccacggagaaccagttgaccagttgcgcgccggcggcagccatgcgggcccaggcagcctgctgtaccacctcgttgaaggtgccggaggcgtcggtcacgacgaacacgtcaaaaccttcttccagtgcgcacagggtcgggaacgccacgcagacgtcggtcaccacgccggcgatgatcagttgcttgcggccggtggccttgatcgccttgacgaagtcttcgttgtcccaggcattgatctggcctgggcgagcgatgtagggcgcatccgggaacatctgtttcagctcgggcaccagcggaccgttcgggccggattcaaagctggtggtgagaatggtcggcagcttgaagaacttggcgcagtcggccagggccagcacgttgttcttgaactcgttcggcgagaaatcctggaccagcgagatcaggccggtctggtggtcgaccaacaagacaacggcgtcattaatgtccagacgtttgtagggtacgttgctcatgtgaaactcctaggtgggtggatgtcgctatgggcgccggccactgtggccggcactgttgttgatcgtcagaaggcaaagcacgagcagccgaaggcgccccagaaaccctggaagtcactgaccggcacattcgacaggcgcgcccgctcgtggctgtgggagtgcaccgcgcacgggccgctgcactggtgcacctgggccaccagcggcgaggtcgggcgccagtgccccggcaccttgaccaccggcgaccagtccggcagcaccggcaccatcggcggcgaaagcttggagaagtcgccggcggcgtacaccaccttgccgtcgaccacggtcagcaccgactcgatccacttgatggcctcttcctcgacgctgaagaagtccgcggacagggccgccaggtccgccagctggccgaccttgatctggcccttcttgccctgctccgaggagaaccaggcgctgccatgggtgaacagttccagcgcggtctgccgcggcagaccttcggcatgcagctccatgccgcccacggtcttgccgctgaccatccagtacagggacgtccaggggttgtagctggagacccgggtggcgtcggtgccggcgcccaccggcacgccttcggccagcatgcgtttgatcggcggggtctgttcggcggccttggcgccgtagcgatcgacgaagtattcgccctggaacgccatgcggtcctggatcgcgatgccgccaccgagggccctcacccgctcgatgtttttcggcgtgatgatttcggcgtggtcgaagaaccacggcaggccattgaatggaatgtcgcggttgaccttctcgaacacgtcgagcatgcgcgagatcgattcgtcgtaggtggcgtgcaggcggaacggccagcgctgttccaccagatggcgcaccaccggctccagctcctgctccatggtctgcggcaggtccggacgcggttcgaggaagtcctcgaagtcggcggcggagaacaccagcatttccccggcgccgttgtggcgcaggaagtcgtcgccctggtgcagcttgacgctgccggtccagttcttgaagtcggtgagttcttccttgggcttctgggtgaacaggttgtaggcaatgcgcaccgtcaactgctgctcccgggccagttgctcgatcaccgcgtagtcgtccgggtagttctggaaaccgccgccggcatcgatggcgctggtcaggcccaggcgattgagttcgcgcatgaactgacgggtcgagttgacctggtattccagcggcagcttcggccccttggccagggtcgaataaaggatcatcgcattcggccgcgccaccagcatgccggtgggctcgccgttgctgtcgcgcacgatctcgccgcccggcgggttcggcgtgttgcgggtgtagccggcaacacgcagggccgcgcggttgagcaaggcgcggtcgtacaggtgcaggacgaacaccggggtgtccggcgccgcctggttgagttcttccagggtcggcatgcgtttttcggcgaactggaattcgttccagccgcccaccacccgcacccactgcggggttggcgtgcggtcggcctggtccttgagcatgcgcagggcgtcggccagcgacggcacgccttcccagcgcagctccaggttgtagttcaggccgccgcggatcaggtgcaggtgcgagtcgttgaggccggggatcaccgtgcgacccttgaggtcgatgacctgggtggcgctgccgcgcagggccatggcctcggcatcggtgcccacggcgacgaagcgcccctggctgatggcgaccgcgctggcgcggggcttctcgcggtcgacggtgtggaattgaccattgaacagaatcagatcggcgttcatcggatgtccttctgaatgggaagaggcaagggacaggcgcggccagaaagccgccgcggcgctgagcaaggacccggctgcgagcaagcggcggcgcagcggatcggtcgggtcatcatcgttattggccatggccgggctccaggtgtcgatcggtggcagaggcttgcaaccagggggcgaacagccgggtcgccaggggcatgaacagatagaccaccgacagcacgatggtcagggtgatcaggaaagtggcgaccacgtaattgccaagccaggcattcagttgcagcacaggcccccagatcagcggcaccagcagggtgtgcggcagaattaccagcatagtcaacagcgcctgtttccaccgtggcggtggcgaagcggtgtcggtctggatggaaaaccagaattcatggaccgggtggacttcggtctggtcgccgtcggccagcatcggcgcagcctcgtccaccagcgtccggcgttgcggcgagtcgagccagcgctgcatcgcctcggtggagcaaaagcgcagcacgcaggtgaacaggtcgaggccgccgctcttgccgcgaatcacgtccacgcccaggtgcccctcgtactgcccggcaaccccgacaatgcgccgcaaccaggcttcatagggcgcctccaggccagccttgacccggtgcttgacgatcagcgtcacgacctcatcggagtccggccgcgcagtggcttcgaggcgattggaatcagacataacgcagggctccggcgaaacgatcattgagggccagccgtcccgggccggcgataagaatgctgctgaacaggatcaacagcagccaggcgaactggccttcggccaggctccattgcgggtgcaccaccagcagtgccaccagcagcaccgcgaggatcggcaggcacgccaggcgcaccgccaccccggcgacaatcagcaacgggcacagcacctcggcgaagatcgccagcatcagcgtcaggttggcgcccagccggaacgggtcttcgatgcgttgcagttccgcgctgtaatcgagcagtttcggcaggccgtgcacccacagtagaaacaacccggcgctgacccgcaaaaacaacagcccgagatcccgggctcgttcatcccatggtgaagcgttcattggcgcactcgcacaatttgaaagatccccggcatcgccgccgagattgcatggtgccgctgcgcggtcgggaaaaattgaatgtatgtgctctcttgccgcagggtccggatcgaccgcccgcgcctaggccgcgtggatcttcaagggttcggacatgaactgggcgatccgcgagcgcaaccagcgctcggccggatcgttgtcatgcaccccgctccaggccatggacagctgcgccgcctcgatggcgaacggcgggtcctcggcgcgcaaggcgcagccttcgaccagggcacaggctgcgtagtcgggcacggtggcgatcatctcggtgccggcgagcaaggcccgcagaccgctgaactgcggcacccccaacaccacccggcggctgcgcccgaccttggccaggtcaaggtcgatattgccgctcaggtcgccggagaacgacaccatggcatggggccgccggcagtattcatcgagggtcaagggttcgggccggttgtcgccgcgcagcaccttgcagccgatgtcccgcagcttcttgcgcttggcattggccggcaactcggtggtgtagctgacccccaccgagatctcccccgaggccagcaaggccggcatcaacaggtagttggcccgacgcaccaccacgactatgcccggcgcctcttcgcgcaaccggctcaacagcggcggaaacagaccgaactcggcatcgtccgagaggccgatgcgaaacaggtcgcagctggtcgccgggtcgaattccttggcccggctgaccgcgcccgagatcgcatccatcgccggttgcagctccttgaggatcaccagcgcccgggccgtcggctccatgccgcgaccgttgcgcaacagcagcggatcgtcgaacaggtcgcgcaggcggcccagcgcggcgctcaccgcgggctggcccatgaacagtttttcggcgacccgggtcaggttcttttcgaacatcagggcttcgaaaatcaccagcaggttcatgtcgatgcggcgcagatcgttacggttcatcggtacggtccccttgtgtgttcagccagcgcacgtcactcgatcatcggcaccctggccgcccgctggtaaggcccgtactcggccggcacccactggaaatgcccgtccaccgcggcgatatggcccacgcccgggaacggcaggtgcgccgcggtcacccaggtcttgctgctggccgcctcgctgaagaccttggcccggctcttgatcgcctgccggtcgtcgacgtcgaaacggatcgacacttccggatgctcgaactgcaccgccaggttatgcaccaggtcgcccatgaacaggatgctctggccctgggaggtaaagcggtaggtggtgctgcccggggtatgcccggcctccagccgggcctcgacgcccggcaccggcgactggccgctggcgaaggtcttgaagcgtccggcggcgcggtacggggcggtggagtcctgggcgatcttgaagaactcccgggcaccggcgggcgccttggccagcgcctgcggatcgagccagtagtcggcttcggcctgggcggcgtagaccgtggcattggcgaacagcggttgccgcttggcgtccaccagcccgcacacatggtccaggtgcaggtgggtgagcaggatggcgtcgacctgctccgggcgataaccggcggcctgcatgttcgccgtgagcatgccggcagtggcgccgatgcactggccggcgccggtgtccaccaggatcagttgcttgccggtattgaccaaaaaggcgttgaaggcggtctgtacccccggggtctcgatcgagcgacgggccagcaaggcgcggatctggccctgggtcatgccctggagcagcttcggcgacaggtcgttgtagccatcgaacagcgccgtcacttcgtagtcgcccaccgccaggcggtagtaaccgggtacctgggtgccctggaccggtgcctgcgcctgggcgccaagcgatgtcagggccaatgccaggactgctccgcgtagcgtgcacagcagagaatgcgtcatgccttcaccttttcgatcgagtcagaaaaacggccactcccgagccagccgcacccggtcgatcatgcaccgccagcgcaccgcgaaaattgcaggcatgtgctcagttgccgcgaatacgcaacttgcggctgagcggaattaacaacgtttaactcgcaagcccaccgccccgccaccaagaatggagccctctgcgcagacctgttttctaaatcgggaagcgcccggcccaccccgcggtgcgccggcgcatgcccaccgacacggaatttcgtcatggcccacgctcagcacaacgccgtcagggcacccgccccgcaaacccgaaaaaccacccccggcggcctttctccctggcgcgaaagcctggtcaagcaaatgatcctcgatggcctgagcgacaccctggaagtcaccgaactcgcccgcgcctgcgccctgtcccgcagccatttctcccgcgccttcaagtgcagcaccggcctgtcgccccaggaatggattcgctgccagcgcatcgcccgggccaagcaactgatccgcaacaccgacctgaccctgacgcagatcagcctggaatgcggcttctgcgaccaggcacacttctgccacatcttcacccacagcgaaggcatcaatccgtttgcctggcggtgtcgggtcctgggcgcccgcccctgcctcgaccaggcgagcgcataaggccgcggttcgaaccttgtcgtatcacgggcttgaatctggcaagccgcacggagatagccaaggctgttgcggttcattgagcgcgagaccggcaggggggcaattgggaagcccccttgttgctccgttctaccctattgcatcaatgtccagattgaaggtggtgcccgggacgtggccgccgaccaaagcagcaatcgcacgatcgttgctgtcggcatctggcggcgccatcgcgagttgttcctgcgtgcgattgaaggggtgcgctagccagcggtccagactcatcgccaatacctcgggctgctcggcaacccgtccgtataccttcgcctcggtgacacgttcgccgctcaggtctttcaggcgcgcagcggtctcttgcaacctgccgatttcagcgcgcagcggccctacgatctggcgttctctgacagaaccgcgtgccgccgcctccttttctctcaactgtgtctcgaagtcctgtagcgcttcatggacccgctcatactcagtcgaagtcaccagggtgcgcccctcctgcagagcctcttgcgcacggcgcaaggaagcccagcaatgcgggatgtagctgacgaccatcttgtggtgggcgttatccaccatttgttgcagcagtccccctcgctttggcaaaccattcttggcatccagtgccttggcgcagaccgccgcaccaccccgctcggtaatcgttttacacccgggcgtccaaaggattgcggacttgtggccatcggcaaacgacactggcatgaaatggcgcagtgtgccgtggtgtgtgtagggttcgccggtgatgttgatgggactgaggaacaagaccacccccccgagggcaggattgaagaacgtaagcacagcgcccatccccgacatacgccaggaggtgttcatccaggtcgccgggacactcggcaccgggtcgttctggttgactatgcggtggtgcaccaaagccttggcgttttccacgaaggtcttgtcgcctacgcgtgggctgccgtaggtatagagcaagatgtcgtaggtgaaaccctctctgaggcgcagcatctctgcgaccaggagggccaccgcaccgcccaggctgtggccggtgatcaccagtttttgcccgctgtagaatttgtccagataagttgcgacgaaggtccgaacggcctttgcggaatcatagaagccgctatgcaccttacccagcccttcctcgaaaggcacttgtgcggcatccaaatcacgcagcacatcagcgccaccggctgtcccccgtaccgccagcaaaaccagttcatcgttatgagtgatgaacgcctgagagtcggtgccatcgtcattctccgcatcgtccaagtagtgaagcttggcaggatgctcctgtccggcccccaactctgggctgtttacttcggggtacagctctgggtcgaacggtacgatctccagacgtttggaatacgctacgtcggcatacagcgggtagtaagttttcccggctgtctgactggcatccacttgccagagctcatcagacttggccagggcatcgccaaaccagttgccgacgctgggttgcgccgggaagctcacacggctgctttccacgggttgcgaattggggtcctggccaaacgggctatagctcagggttgccatcagggccaactggtacagattgagtgagcagaatttttcgcccgtagacaggactggactcagggaccgcagcgggcgcacctccagcacatggtgtttgttcggtaatagcgcaatgccctgcaccttaggaggcgtggggccaaatcccaattccgccatggcggccgcttctgagggccggcgcatcagcgagtgcacgtagtgctggggcggaaagttgcggagtgccagcggcggtaggtgggcacgatgcgccaccaattcgctcacctcgacctggcagaagaaaccggcttgggcttgcgcggggttggactgagttcgggcgccgcttgggttccgaaaacgagtcttctccgcgcgcacttgcagctcggtgataggcagcgggtaatgcggtctttcttttaaaaacgtataactcttctcattcccttggtaggtttgatcaagcctaagcaccaccggtccgcaataatgtcgattgactttgcctgtgcctgtttcgtccagaacacccaggtagatggcgccttcataatcagtggcctcatacgccaaaccggcataaggagtaccgtcgccctcttcgtccaccagttgaaagctggtcgaatgtgtccgcattggacaagcatgcatgcgcgtatcaaagaaaggctgctcccactcttccatcggctcaaggctcatggggtcacctccttgtcttcggtgcaacctggatagatggtgcagatgcggccaccgggcattctgaatgtgctgaaatccttgtagttgccatagcaaaacgcgtattggtctgcgaagttgtctcccatgcaacgcttccaaccaccaggcaccttgacccaagtgtctccgacagcaggcctttcctcatcggccagcttgattttcatcttcacggttttacccggcagctcgtcgagggtataggccgcgaaaggtcgggttttcagcagttcgccggatgcatcggtctttttgcagtcgaggattttcacgatacggcgcagtcctccagacgtacgaaacagccattgacactgaccggaaaactcgctttccccggcggcattgaacgtacctttaaccgtttccggcaattcttcgcgcaccgaaacccgggcatactcgcgccccaagtcgccccagtccttgccataggtcgcgttgatttccagctcgacgtgatcgaccaccagttcgcagcccttgcgagtccgacgtatctcgatttgcgcatccggcttgtattcggtgcgccactcacggttgaactgcggcgccagattgtctgccctcggcacggtgcaggtttgtcctttggcgggcacgtaatacaccgacgcgacataggcgaagtccggtggcaggtcggccgtgagggtgaagctgttggacttgcccagggcggcgcacccctgtaccagcgccaggctgctgacaagaatcaggcgttgaagggttcggttcatacggcggcatctccttgccagaactgcacttgctgatacacacgctgaaaatgcgtcaggggtgtttcgtcgagttgaggtaaccaggacctgggcagtgcttcccgcggtgcttgcaaacgttgaacgagcaggaaccggacttgctcaggcgcctgccagccccacgcgcgggccaactctaactgagcctgtagccaggtgtccgcatcctgttgcctggcaagttcggccagccgctccatctgctcaaccatcaggtagcgccggacgttatcgatctgtatgcctgccgccgtgtccgcggtcggcgggacagcgagccacgccggggcgggtggtaccgggtattcgcccggggcgggattgtaggcggccgcccattgcccatcctgccagtaacacacgctggctatcggcccgaggaattcgctgcgttgttcggggcgcaggtgtgccaaggctcgccccaggacacgattgtcatgaaaacgatagagggcctggttcggccgctcccccgttaccaggcgggcgcgccaatggcgggtcagttgatccagatcgccgcttgcgctgctggccagccagccccaatgacgctccggcgttttgagcaagacctggatggctggatgatccagcgtatcgagctgaaaaaggtatgggcctattgctgccagcgcgctggcgggcgtaccgctgtacagattgctgtactggtcgtcatccctctcgttgagcagcgcattgcgctcatccagctgaccaacggagtccagtatcaggtagaggcgctggccgagctcaccctggacgcgcaaccattgttcgggcgtgctcatgccacttctcccacactgcattgaccctcgcggcaggcttcgcagagtgggcagaagtccgcagcgcgttgcctggcggcggcaacgagcgccaacgaattggcaacgctggtctgcggctcctcggccagtgcctgtagggtctgttgcggcgcaatccctgccaccggggctccgccctgaacgatcggcacgctgctgaagatccccccaggggtaatgacgatgtgctggccgcctgctttaagcgtcaggcttgtactcgcatcaaccaccacatcagtggcagtgacccgagcctggggccccgcttgcacgacccaggttccgcctacggtgatgctgccattgcccgagatggagagcagttcattgccgccgatctgggtgttccgtacgccttgggtagtgtgcagttcgtcacccttgaccaggctggagctgttgctgtccacctgatcaaagcggtcgttgccgatcaggctatggctgtcccgggtgatctgttcgcgccggtcgttgccgatttgggtgtcgctgtcgttgaggatcagctgctcgatatcacgttgcgcgcgcaggtagattttttcctgcccggcacggtcctcgatcgacagttcgttgtagccgccactgtctggcgtgctgcgactgcgtaacacggtcttgcttttgttcgccggcaacgcgtaaggcacgggtgtggtcttgttcggcacaacgcccgtaattaaaggattgtccgggttgccttcgaggaagctcaccaccacttccatgccgatcctcgggatggtcactgtgccaaagttctcccccgcccaactggaagaaacccgcaaccagcagctgcttttgtcgctgcccagctcccgtcggtcccaatggagttcgacctttaccctgccaaactcatcgcagaagatttcctcgccggtcgggccggtgacccgggcggtttgacagcccagcaagggccggcgcgtcagcagcggcggacggaaaaacacgtcccacggaatcgcagtgaagctgttgcgatagccctgggtgaagccgtcttcgggctgggtgtcgctggtgacggactcttcgagtgactgcggttgtcggccgcaatgcgtgacgctcagcaacaaccacaagtcgttgcagctgttgcgcgggtgttcggtcaggttgaagaagtgtccgctgcgcagcgtcggctgatcgctttggccttcggccaactggtaatcgacacggtgccgctccagggcctgcctggccaacactctgccgcgctccagcgtggtgataggtgcggggtaactgtagtcctcaagcaccggctggaagtccgcggtgaattggctttcgagcagcagactcggacgtttcagatcgtaatcgcgacgcgtcacggtgctggtacgagtgctgaagcgctgggagaaccggctgaccaccggatggtccgctaccgtgccggtgtcctgctgatagggtgtatcccccaacagggggaaacaggtctggtcatcggtgaacaccagccgatggccctccgccgagtgctggtggtgccaggcgatgccgtcctcggcgcacagcctctggacagactcgaaatcgctttccccgtactgggtgcagtattcgcgctccggactggtactgacattgaagctgtagacgtcgggctggatgccgtggccacccagcacctgggcgatgatttgcggcactgtcaggtgctggaagatccgctggttgcagctgaattgcaggtagtgcagcaccggcaccagggtcaggtgatagcgcgtcaggcgcttgcctgcctcgcccacatacacgtcttcgatatgcccatgaaggccttcgccgttcagcccgaaccgaaggaaggccggctgattgagcaggctctccaggtcgacgtcagggttctcgctgaccagctcgacgcggatcccatagagggtgctgagggcttcgctgccgtcgaaagccagtaccttgaagtcattgcggacggctgggatcgacagcgtgaagtgcgcggtgttggcgggcgcaaacatttagcttttccttaagcgagacagcgggcctttcaatgacccggagcaaatggctggcaggacattagcaatgtcgccccccaacgtctgcgggactttacttaaagtcgatggggattttgagaggattccaagggccgaataggcgtcaggcggtcggcagtcaggtcaggtttcgcaaagcaccggcataggttgaactcgtccaagcaattgacaaacctgctgtatcagactgcggcgtagtccagcaaacttcggtactggaatcatcgtgaaaataaaaaacgccggggggcaaaacctcccggcgtttttttatggatcaggcgcaggtcgccgaaccactcaggcctcgatgaacgccagcaggtcggcgttgagctgatccttgtgggtgtcggtcaggccatggggcgcgcctgggtagaccagcagcttcgcgtccttgaccagcttggccgaggcgatgccggcggcttcgatcggcacgatctggtcagcgtcgccgtgcaccaccagggtcggcacgtcgaacttcttcaggtcttcggtgaagtcggtttcggagaaggccttgatgcagtcataggcgttcttgtggcccgccgtcatgccctgcatccagaaccagtcgatcatgccctgggacggcttggcgccaggctggttgaagccgaagaacggcccgctggcgacgtccttgtacagctgcgaacggtcggccagggacgcttcgcgcaggccgtcgaagacctcgatcggcaggccgccggggttggccgcggtcctgagcatcagcggcggcaccgcggaaatcagcccggccttggcgacccgcgccgtgccgtggcgaccgatgtagcgcgccacttcgccaccgccggtggagaagccgaacagcaccgcgtcttgcaggtccaggtgttcgatcaactgcgccaggtcgtcggcgtaagtgtccatctcgttgccggaccagggctggctggaacggccatgcccgcggcggtcatgggcgatgacccggtagcccctggatgccaggaagatcatctgcgactcccagctgtcggcattcagcggccagccatggctgaagacgacgggttggccgctgccccagtccttgtaatagatctcggtaccgtcgcgggtggtgaatgtactcatggcgtttttgctccttcagggggtggggtgactcaaatcgatggatgggccatacgctcggccaggcgcgccacccgctcgcccaggtgcgcagcggtgcggcggtcttccaggggcggcgcgtgttcgggggactgttcgacattcgactgggccatggcgcccagggaactgccgaggcgattcaactggccatcgaacaccccgcggctggagcgcgccggcagcaggtcgaggccgacccagatcatcgagtgctgggccgcgaagaccgccatctgcaccagggtgttgagcttgtcgccacacaggcaaccggaattggtgaagccggcggcgagcttgtcgcgccagggctgggccaggtagaacgccgcgctggcctccatgaaccccttgaagggcgccgaggcgctgcccatgtaggtcggggcgccgaagatgatggcatcggcctggtgcaggcactcccactgctcgtgcacctcctccaccggaatcagccggcaggcgctgcccaggtgactctccaccccctgggccacggcttcggccatgacccgggtatggccatagccactgtgatagaccaccaccaccttgctcattccgccatcctccagaggtgttcatcccttttccctgcgcgcggcacacccgaccggccctgcggttggcgaccgtgaaggtctggagttttggccgtagggcggacccagggcgagttaaacgttgttaattttcaagggcccaggcaccgcccctgcccgctcgtcgccaaggccacgaccaataaatacgggacccatcgctggcaagaagattgctgcggctagcgcactcgaggcacgcccgtccgcgccgcgttgcgttgttcgggaaacctgaggaacatgctcgaaaaccgcgggatagaaggtcgtgcccttcgtccgcccgccccgcgcaggtgccacggggaggataaaaaaacagcaacaggagtgagccgttgaccctaccccccgaacaggctgtgcatttcggcccctaccggatctacccggggcaacgcctgatactggaagccgagcggcccttgcgcctgggccgccgctccatggacatcctgctgatcctgctggagcacgccggcgaggtggtcagcaagcagcaactgatcgcccgggtctggccaaggagcgtggtcgaagacaccaacctgcgggtgcacatggcggcgctgcgcaaggccctgggcgacggccaggccggccagcgctacatcgtcaccgtggcccagcgcggctatagcttcgtcgcgcccttctccctggaaccgttcgctcccgagcgcttcgagcaaggccccaaggacccttcggccgagccgggcgggcataacctgccggtgcgccgcacccgcctgatcgggcgccaggccctggtggacaatgtgatgacgcaactggcgcgccagcgcttcatcaccctggtcggccccggcggcatcggcaagaccaccgtggccctgcgggtcgctgaacagctgatcggccagtaccgggacggcatccgcctgctggacctggccccgctcaacgacccgcggatgatcaccagccacctggcgaccctgctcgacctggcgctgcacgacgacgaaccgctggccagcctggcgaacttcctgcgcgagcggcagatgctgctggtgatcgacaactgcgagcacctgctcgatgccatcgcaccgctctgcgaaagcatcctgcgcgcggcgccacaggtgcatgtcctggccaccagccgcgagagcctgcgcgccgagggcgaattcgtgcaacgcctggaatccctggattgcccaccgcccatcgcggtgctggaccgcgaccaggccctgaccttctcggccctgcaattgttcgtcgagcgggcgatggccagccacgacagcttcgaactgagccaggacgaactgcccctggcgatcgagatctgccggcgcctggacggcattcccctggccatcgagctggccgctgcccaggtcggcaacctggggctcgcgggcctgttcagccagctgcacggcagttttcgcctgctgacccagggctgccaggtcaccccgggccgtcatcagaccctgcgcgccaccctggactggagcttcgaactgctcagcgcctgcgagcagacctgcctgcgccggctgggcgtgttcaggggcggcttcaccctgccatcggccgcggcggtgatcgtcgacgcgcacatcgaagccagcgtggtttttaccgcgatcacccagttggtggccaagtccctgctgaacgtggaggtcggcgacgaggaagtgttctatcgcctgctggacaccacccgcagctatgccctggaaaaactcgagcaggccgccgaactgccggctacccgcaggcggcacgccgaacgttgcctggccttgatgcatcaggcccgggacgactgggagcagacgccctcgacgctctggatcgagcgtcacgcccgcagcctggaagacatccgggtggcgctcgactggggcttgaatgcccagggtccgcaacagctggcgatccacctggccgcggcctccgcaccgctgtggcaggagctgtcgctgctcaaggaacacggcggctatgtgcgccaggccctggccctgctgcacgcggcgggcgaggcctgcccgcgcctgacccaggccctcaagctggccctcggcagcgcctgctaccacacccagggcaacagcaccgaggccatcgaggccttcgtcgcggccagggccctggccgaaagcaccgacgacgtggccgcccagctcaaggcggtgtccgggcacatggcggtcaacctcagttgcggtcactaccaactggccctggagcaaagccggcagttcgaccacctggcgctgcgcgatgccggccctgccgcgatgtccctcagcacccagcgcctacaggtgctggccctgcactttgccggcgatcagccgcaggcccgggacaaggccgagcaagtcatccagctgatggcccagagcgggcatatgaaccgcttcacccgcggcttcggcgtgcagtacgaccagagcgtcgccgccctgacgatcctggcgcggatcctctggctgcaaggccacccggaaaaagcctggcgcaccgcgcgccaggccctggacatcgccctgcagatcaaccacggcacgtccatctgctacaccctggccctggccggctgcctgatcgcccactacaacggtgacgccgcgactgcccgcgaactcctgcgcctgctgctggagcaggcgcagaagcattcggtgctgctgttctacacctggggccggcactacgcgcaggtcatcgaaggcgccccggagttctcgccgccgcaatccggcaccgggctgatcggcgaaatcatggtgaccctggacggcgctttcatcgacaacgccttgctgcaacgggccgaaagcggcacggccggctggagcacggcggagatcctgcgcgccagggccgaggcgctgctgaccgacaatgcgcctgacgccgccgaggcggtgctgcaccaggcgttggctgtggccagggcccagggcgcgctgacctgggaattgcgcagcgccacctcgctggcccggctctggcagcgccagggccaggcccggcgcgcccatgagctgctcgaaccgctctatgcccgcttcaccgagggttttgccacgccggacctaacccgcgtccgggaactgctcgatgagctgcaacgacaggtgcctgactgacagccagcgggccttgccgatggcgtgggcatgccgcctttcgaacacccgcagttgcccgctgtgttccagcttttgcagcgcgtaggcgcgggtggtgtcgagaaagcggtaatgcgccgtgccctggccctgctccaccgccagcagcgatttgcgcgccagttgcgccatcacctcggccacgcactcgggccgcaacaccgcacagctgatgacgtcggtggcggcccgcacggtgaaggccgtgtcgaacaccgccaggcgctgcaaaagggtctgctccagcgggctcagccgttgatagctccagtccagggcggacttgagcgtctggtgccgggccacggccgtgcgccggccctgggtcaacagttgaaagcagttgtccagctgcgcttgcagccccaccagcgccaacgcgtcgatctgcgccgccgccagttcgatggccaatggcaagccatcgagccgccggcagatctcgcgcaccgccctcaggtcctgttcccgcaaggcaaagccttgctggcgcgcccgggcacagctgacgaacagctgcaccgccgaatggctcatgacctcggccacgctgtgcaacgacgaggccggcggcaccgacaaggccgccaggccatgcacggtctcccccgcagcctgtagcggctcgcggctggtggccaggatcgacagccgtggcgccgaggccagtaactgctccaccactgtctggcagcgttcgagcaggtgctcgcaattgtccagcaccagcaaggcatgccgggttgccagcgcctccaggccggcgtccagttcgaggctgtgcctgacgtgctcgaccagttgcgccgggtcgtcgatgctcgccagatcgacgaaccacacgccgtcgcggtagtgctgcaacagcaactcggcgacctgcagcgcgaccgtggtcttgccgatccccgccggaccgaccagggtcatgaaccggcgcaccggcagttgccggaccaggctgccgaccaccggatcgcgaccgatgaccggggtcagccgtgccggtaggttgtgctggggcctctgcaggttcgcgagcgcgagcggctctgcttgcgcctcgcgcagcaccggggcgctgaaacaataaccgcgctgtggaatgttgacgatgtagcgctgcccgtcctggccgtcgccaagggcgcggcgcatggcggcgatgtgcacgcgcaggttgatgtcctcgaccaccgagtccggccagacgcaggcgatcaattcgtccttgcctaccacctggccggcgcgctcgaccagtacccgcaggatatccagcgctcgcccgcccatgcgcaacggccggtcgccgtcgaggaccagccgctgccgcaggtggaaggcgtaggggccgaaccgcagcagcccatcgccgttcaaatctctgatgctgttcatgcccatccacgtgctggaaacccggccggcgccaggctcccgcacctccatttccgagagttccccggtatcttggcaggcaccgatgacggtacaaccgtcctggagggagcgtcacggccatcgcggtgcgccagacggacaagccggcgctagctgaactgttcgcggtactgggtgggggtcaggccgagcttttcgccgaacaggaaacgcatgtgccgcacgctgccgaagccgcttttgtaggccacggtcttgagcggcaggtcgctggtctccagcaggtttctggcgcggtcgatgcgcgcgctttgcaggaactccatgggcgtcatgtttacctcccgggcaaacacccgggcgaaatgccgcgtactcatgttcgccaggctggccatgcgctcgatgctgaaggcttcgtccaggtgttcgagcacatggttctgcacccgggtcaccggcgtctcctgcggcgccaccgtggccatcaacgggctgaactgcgcctgcccgccctggcgcttcatcaccaccagcaacaccttggccacgtcctgggcaactttcttgccgtggtcccgtgcgaccaccgccagcgccagatcgatgccggcggtgaccccgcccgaggtgatcaggttgcgatcctcgacaaagatctggtcggtctccaccgtcgccttggggaaggcccggatcaggcgttccgtgtagtgccagtgggtcgtcacccgaaacccgtcgagcaaaccggcgtgcccgaggatgaaggccccggtgcagatcgagccatagaccgccgagcggcgcacggccgccgccagccagtcgagcaagggtcggtgcttttcgttgtaggcccccggccccccaggcaccagcagcaggtcatagctgccgcgcgcctggtcgatatgcagatcggcctgcaccttgacgccgttggaggcgcgcaacggaccgtgctcggtgccgatcgtcgagagctggtaatagtccttcggctccagataacggttggcgatggaaaacacctccatgggcccggccatgtcgagcaggagaaagtccggaaacaacaccattgccacggtcttcatgggtaaataccactgatatcaaagggttggaagcataacgccgaccctggacattatgcccggacggcgcgcgctcatcggacaagaatacgtgattcatcgcacaaaattgtcaacctgaacgagacagtatttcagtttccatctacttattgcgccgcagggtaaacattagccttctcctcaaccggacgaattcccgttccgacaggagattccctcatgctgacccttcgtaaagcctctgatcgcggcgccgccaaccacggttggttgaagtcgttccacaccttttccttcgccaactatcgcaacccgcgggaacagggtttttccgacctgctggtgatcaacgacgaccgggtcgccgccggcaaaggcttcggccaacacccgcaccgggacatggagattttctcctatgtgctcgaaggcgccctggaacacaaggacaccctgggcaccggttcggtgatccgtcctggcgacgtgcaactgatgagcgccggcagcggcgtggcgcacagcgagtacaaccactcggccacccagccggtgcacttcctgcagatctggatcgtgccgaacgtcagcggcgccaagccgcgttaccagcaagagcatttcagcccgcagcaaaaacgcggccgcctgcaactgatcatctcccccgagggggccgacggctcgctgcaggtgcgccaggatgcgcgggtgtatgccgggctgatcgacggccaggaaagcgccaccctcaagcttgacgccaaccgctacgcctatgtgcatgtggcccgcggctcggtcgacctcaacggcctgctcttgcaggaaggcgatggcgtgcgggtacgcgaggaacaggcgctgaccttgagcaacggcgtggatgccgaagtgctggtgttcgatctgcgggcgcaggaactgccggaaatgccttgaccggcaccggcccgggggcttgcgcctccgggccttttttcgacgttgacaggcggcctggggccggtggaagccctcgactgcagcggctgatagccgctagcgcctattcgttcgcttcaaccagcctgaccaagttgcacaagggcgttcgccttttccccctgccctctgcggccgttcgacgggcgtgcgatgcgctcccgcctcaaaacgtctgcgctgctccctggcctcgcgcgccatccagcaacgcatccaccaccgcccgcgccatctccactgaatggatcatcgaccagatcaagccgcgctcgatgccgctggcactggtgatctcatccgccgtctcctcggcgcacttgagcaacaacgacacatgcaacaacgcctcctcggcgctgacgccagggcgaacggcgaatagcggacggccgttgccgtcgcgacagccgaaagagctgctgccggtttcctgcaagctacggtgcaaaggctcgccgccatcgctgcgttccagcgcctgacggagggtttgattggggatttccagttggacgatccgctcgcggctgggcgaaagaatgggcggatcggggacgatctttttcatgacgcggctccttctttgatgaagaccgccagcatcacttgcagatgatgggtggcggctacgtgcaggtctgcaagaccgggaagaagaagcaaacccggcagacccgaaagtctcccgcacgcagccaccataaatcgcgatgacatctcaacgatcctgggtgtgcgtccagcgcttcttgcttgttcgggcttgcagtcccggccgctgattttgcagcgaccggggcagcctagccccgaacattcagcagacacaagacgccaaaaccacagaaatgtaacccggcgattctctcggaaataccctacaaatcaaagagaaaaaccgctcaaaccgtgagcttttttcgcgagcaatcgagcgtcgaccggctgctcctacaaaggccaaatgcacaacctgagaacgccccaatccctgtagccgctgccgcaggctgcgatcgaccgcatagcgggcgcggggtcttgagaccgctggaggaccttcggtcctatcgcagcctgcggcagcggctacagggtacgtgaaagcccgcatccgaccaccaggcgccccttcagccctgccccttgagcaaatgacggatccggatcttcaccccgtcgctctggaagcggcgggcggcggcctcgatcttcagctcggcgcgggtcacccgctcgtggtggcgcaggtggccgacccaggattcgtcgaagaacatctcgcaccacaggcgcgggttttcgctgtcctgcagcaggcaccaggaaaacgaaccgttgcgctggcgcatgcgccgcaccgggttcatcgcctgctggaaggcctgggcgtgttcgggggcgatgtcgtattccaggctgatcatcaccggcccgcgttccaggtcctggtcgtcactgagcagcggttgcggccagtgcagcgacggcgccaagtcttcggcgctgcgctggggcaagccgacccgccaggtcagcccgaccccggccagcagcaccgctgccgccaggctcagggcaacgctcatggacaacaggctggccacccagccccagagcaacccgcccagggccatgctgccgaagaacatcaggatatacaccgccagcgctcgtgcccgcacccaggccggcaccgaggtctgggccgccacctggaaactcgagagcacggcgatccaggcgccgccgctgatcagcatcaccgggatcaacagatagaagtcgcgcagccaggccagggcgaacagcaccagggcgtaggtcacgctggccagcgccaccaggcgatccaccgccaggcgctggcgcagctttggcaacagcattgcccccagcacggcgccgaggccgacgctgccgagcaacacgccgaactgggtcgcgctgccctgcaactcgccgcgcacgatcaacggcagcaaggacatgccggcgctggcaccgaagaagaaccccagggtacgaatcagcacccgttgcagagggtgggaactgcgggcgtagcgccagcccacgcggatcgcactgaacagccgctccgccggcaacaccgcgaccttcggctcgcgccgccagcaggcgagcacggcgatcaccgcaaagaacgacagcgcattcaccgcgaaggtcgcccagggcccggccaggctcaccaggacaccggcgatggccgggccgacggcgcgcgccacgttggtcccgacgctgctcaaggcgatggccgcgggcaactcgccggcgggcaccagttccggggtcagggccgaccaggccggcatcatcagggccgtgccgatgcccatggccagggtcaacagcagcaacaagggcaccgtcatcaggccgctgagggtcaggaacgccaggagcatggcgacgctggccatccagccctgcaccagcaacaggtagcggcgcttgtcgacgatatcggccagcgcccccgccggcagcgcgaggaaaaacatcggcgccgcggcggccacctgcaccagcgccaccgtcatcgggctggccgacagcgaggtcatcagccagccggcgcccacctcgtgcatccaggtgccgatgttcgaggcgatgctggccagccacagcccgcgaaacaggccatgcttgagcgggctccagggcgaaagggaggccgcgctacgggaggaatcgagggtctgtttcatgacggtccttgagtcgtgggaacgctgtgcagtccggatgttttttaccgctaacgaccatcggccgaggcaagcgggttgcgtcggccgatggtcgttggcgacaggcttacttgacctgacgctgcggcgccttgtgcaccatggtgtaggcgtaatccacgcccatgccgtaggcgccgctgtgctcgcgcaccaggtccatcaccgcgtcgtaggtgtccttgtgcgcccagtcgcgctggaattcgagcagcacttgctgccaggtcaccggcaccgcgccggcctggatcatgcgctgtaccgacatgtcgtgggcttcctggctggtgccgccggaagcgtcggtgacgatgtacacctcgtagccttcggccagggcttccagggccgggaagttcaggcagacctcggtccacagcgcggccatgatcagcttcttgcgcccggtggccttcaccgctgccaccagtttcttgtcttcccaggagttcatcgaggtgcgctcgatcggctgatggtcggggaacacgctgagcagttccggccagatgtagccgctgaagctctcggtttccaccgaagtgaagagggtcggcacgttgaagatcttcgccgccttggccaggcccacggtgttgttcttcagggtctggcggtcgatcgactgcacgccgaaggacatctgcggctggtggtcgatcaggatcagggcggagttgtttgggttgagcagttcacggatagacatggcgcgttccttttgctgtcgagtaggttcaaacgttgagttgcacaattcgggagctcggcgcgggttccgctggggaggctttgctgccggcttggtggctaatttaggggtcaaaacaaaaagggacaatccagcaaaattgagaataattgattctaaaaaagggacaattcaaaaactgccgcagcgcccactgcaaacggcacctgccgcctgcctgcccgcgcaaacggccgaatgcagcacagccgtacaatccccgcgcggtgtaatacgcaaccatgcctcgcctcgatccgatggccacgccgagcggacgcgggttgaccgaaggcgtgccggcagctgccggaaccgcggccagccgcgtccggggccacccaccttgacgcgggatataagcatgctgcttgcctcgaaacacctcaccgccctagggccgatgcgcacccacctgaagccgctgtggctgctcgccttgctcagcggcggcgccccggcgctggcggcacagagcgcgcaggacacccccggttttcttgagggggcgagccttgaagtgctcagccgcaacttctacctcaacaacgactatcgctccccgagcccggccggcaagagctacaagcaggaatgggcccagggcttcatcgcctcgttcgcgtccggcttcacgcctggcactgttggcgtgggcgtcgatgcccatggcttcctgggcttgaaactggacggtggcaaggggcattccgggaccggcctgttgccgctggatcatgacgggcgcagcgaagacagctactccagcgccggcggcgcgttgaaattcaaggcctcgcggaccaccctggcgctcggtgaaatgaccgtggcgactccggtattcgacaccgccgacaaacgcctgcaaccggaatacgccagcggcctgctgctttccagccgggagatcgagggggtcgagttgcaggccggtcacttcaacgccttcaagaaccaggacgcctcgaccgccaagggcgacttttccggttacggggcaaccacccgccacgccagcatcgacttcatcggcgccgacctgttcgccggccaggcgctgggcggcgccctctacgcctcggagctgagcgacacctggcgccagtactacgccaacctgcatgccagccttggccagtggttcctcgacggtaacctgtaccacacccgcgaccagggccaggccgcggccggcgccatcgacaccacggcctacagcctctccggcaaataccggatcgacgcccaggcattcaccctggcctatcagaaaatccacggcgacacgcccttcgacttcgtcggcggcgactccatctacctcgccaactcgatcaagtacgccgacttcaacggccccggcgaacgctcctggcaagcgcgctacgacctcgacctgggcgccctgggcattcccggcctgagtttcatggcgcgctatgtgagcggtcgcggcatcgacggcagccacgcgccccagggcggcgcctacaaccccttcgatagcgccagcggcacctacagcccgcaacagggccggggcggacgccattgggaacgcgacctggacctgcactacatcgtgcagtcgggtccggccaaggacctgtcgctgcaactgtcccacgtcagccaccgggccaacgccgcccaggccggcgacgatatcgaccggctgtacatcgtcattcagtacccgctcaagctcgggccgttctgaccctgcgcggcgggccgaaccggctcgggccgtgcgccgggggggcccgctggcagcgaccaaaccgccgctaacccaaggcatgggccacctgcgcttctggcactgtcgcgtcccgcaacacccgcgccagcaaggcgccgggctgggcgcccgagacccggatgtcgccgatgcgaaaggccggcagcaccccgcccgaccagcccgcggcatcgcatttgtggcgctgcagcgcggccgatcctgcgccgctgcgcaggtagtcgagcagccgctcctgttcgcgcttgctgtccccgcccagctccgcgagcacccgcgcatcgccgatatcgtggccctcgcagaaataggcacggaagatccgcgcgaacagcgcggcgcaatcgccaccgcgcgcggcccgctcaagcatcaggctgtgcgccgggtcgctgtcgaccaggcgctcgattcgctcgaaggcgaaacgcagccccagcgcctggccggcccgggtgatctgcgcttcgaacagccggctgcgcgacaggctgccgaaccggcgccgggcgtactcgccctgctcgatgcggctggcgggaaggtcgaacgcgcagcggctcggcacatagacgatcggccgaggccggtgcgcggccgccatggcctggcgcaggttcagctcgccgatccagcaccagggattgatgaagtcgtacgccagatgaatgacgttacccatagcgaccaccttgcttctacccatgatggccagactctaggcgcgcacctgccggacgagtagccacagggcgcgcaacgctgtcttgctcaagacccgagggaggctcaggcggcgaggatttcctcgaggaactcgataaacacattgatgcgactggagccgcgatggttgggcaggtacagcgcgttgatgcaggtgctggcggtgccgggattaacctcgtactgctccagcacgcgggtcaggcggccctggccgacatcgtcgcgcaccagccagtcggccagcagcgccacgccgccaccggccagcgccgcctcgcgcagggtgtcggcgttattgctctgcaaccgcccttgcacccccaggcgctgggggttttcgtcaccctggaaggtccagtcctggtgcacgccgccatagtcgaagcgcaggcactggtgttgcagcaggtcgctcggctcgcgtggcaggccggtgcgtgccaggtagtcggggctggccacgacccaacgctggaagtcgccgatcttcttgctgacgatgtcatcgctgaccaccgaggaaccgaggcgcaccgagacatcgatgcgctcgctgatcaggtcgctgacccggtcgctcaacgacaggctgatctccagccccggatggcgttcgagcaggcgccccaggtgcggggcgatgatgcgccggccgaactccaccggaacgctggcccgcagatgcccctgggcctcgctgccacggtcggcgacgctggcgtcggcttcgtcgatggcctcgagaatcgccacggccttgtcgaaataggcctgcccggcgagcgtgacactggtgttgcgcgtggtgcgattgagcaggctggcgcccagttcgctttccagccccgccacctgccgcgtcaccgaagacgtcgacaggccgagcttgcgcgccgccgatgaatagccgccacagcgcacggtttcaacgaacattttcagcgccagcaacttgtccataagccgattccgagagcgaaaaatcatgccagggactatgcctgagcacgcatcgagggtcttgtacgcttgtgctcaagcgccgcggcctgcgcttgcaccttcgccccggatcctcagccctggcggtagtgacggatcagaaacagcagcagcgccaagccagggaccgcggcaatcgaggtcgccgacaggctccaccctacctgctcatacaacgggctggccaccagcgaacccagggcgccgccgacgaagatgctggtcatgtacaccgcattcaggcgcgcccggctgtgcgggtcgatggcgtacacctcacgctggccaagcaccatgttcaactgcacggcaaaatccagcagcaccgcgcacaccaccagccacaggtagccactgcccggcagcgcacctatcagcagggacagcggcgccagcaacaaggccacgagagtgccgcgctggccatgcccggcgtcggccagccggccggcgatcggcgccgcgatcgcccccaccgcgcccaccagggcgaacaccgccacctgtgcctggctgaagccgtgctggcgaatcagctcgatgggcacgatggtccagaacaggctgaagctggcgaacaacaagccctggtacaaggagcgctcacgcaggccggcatggcggcgcgcaagggcgaagaccgagccgatcaactcgccataggaagactgatgcgtcggcatgcgccgtggcagggcaacggccatgacgcaggcgatcaccgccatcaggcccgcggcgctgaagaacaccccgcgccagccgaacgcctgggccagcaggctcgacagcgggcgcgacaacagaatgcccagcagcagcccgctcatgatgttgccaaccacccgcccgcggctttcctcgggcgccatgtgcgcggccaacggcaccagaatctgcaccgccaccgaagtcaggccgatgagcaacgacagcgccaggaacagcgaaggcgactcagtaaagcccgcggcgatcaggcacaggctcacggcgagcgtgaaccccaccaccaggcgacggttttccatcaggtcggccaggggcaccaacagcagcaggcccgcggcgtagccgagctgggtcagcgagacaatcaggctggcatgggcgttcgacaggccgatctgcggggcgatcagctcgacgatcggctgggcgtagtaaaggttggcgacgaccgcgccacaacagaaggccagcaaggccaccagggcgccagagagggtagcgggccgttcgcccttcaccgccgtgctggccgtcgttgcaaagttgccggtaggcatgatgaaacctcgttcgcgtggagaaaagtttcgccaaggctaggcgcgacgctcaatcgggagaatccaccgccggggcaattgagcgatgcgcatcacgcaacgatcccggcgttgccgatggcgcaaaaggcctttgcgcggtttgccaattccgccgtcccccccccttctctacccttgggcacttgccacggggcggtccgtcaccgctctcctcagcggctcaaggagacttccatgaccccgactgcatcactgtccgcccacgcggattccacggaccaatgaaggatgacccgatgaacgccaggcagttgtggctgggcgctgtggttctcgccacggcaggcgcaataggcgccgcgctgttgatgtggcgcccggcgatcgcgccggccgaaccgccacaacgcttcgacgccgcccaggtgcaacgcggcgcgcgggtcgccgaagccggcgattgcgcggtgtgccacacccgccccggcggccgctacctggccggcgggctggcgctggtgacgccctttggcacgctctacagcaccaacatcaccccggacgccgagaccgggattggccaatggtcattgccggccttcgagcgggcgatgcgcgaaggggtcgcccgcgacgggcatttgctgtatccggccttcccttacgcctactaccgacgcatgacggaccgggacatcacggacctctacgcctatctgatgagcggccccgccgagcattcgccggccatgcagaaccggatgaatttcccgatgaacatccgcccgctggtgtcgttctggaacctgctgttcctgcacgcggcgcccttggcgcccgtggcgcagcaatccgcaacctggaaccgtggccgttatctggtcgaaggccccggccattgcgccggctgccattctccgctcaacccgctgggcgccgagcagtccgcccagcatcttgccggcggcatggtggacggctggcaggcgccgtccctgctgggcctggccgaccggaacgcgccctggaaccgcgagcaattggccggctacctgcgggctgaggtggtcgaggaccatggcaccgccgccgggccgatgcgaccggtcagcctcagcctgggcaccatgccgggcagcgacgccgaggccattgccgactacctgctgagcctcaaggaccccgctcccgccgcacccgcttcagccaccgcgcgccctgccgaggtggtcgagcaggcgcctggcgcccagctgttccagagtgcctgcgccggttgccatggcccggccgcgccgatgcgccagatcgatgggcgcccggccctggcgcggacgtcggcgctgcatgcctcaagcgcgcgcaactttctcaagaccgtgctcgaaggcgtgcccgccaccccggggttgcccggcccggtcatgccgcccttcgccgccagcctggacaaccagcagctggcggtgctggcctcgttcctgcgcgaacaggccagcccgggccagccgtgggccgacctttcctccacccttcacgaattacgccaggaggcgcaatgacccacatgaccctcaacgtcaacggctcgccccatgcgctggagctggagcccgacatgccgttgctgtatgcgctgcgcaatcacctggggctcaatggcgccaagtacggttgcggcctgggacaatgcggagcctgcacggtgctggtggatgaccagccggtcttctcctgcctgacaccctgcagcggcctggagggcaaggccatccgcacggtggagagcctgggtacggcggtgcgtccggggcctttgcaaaaagcctttatcgaggcccaggccgcccagtgcggctactgcatcgccggcatgctgatgcgcgcccaggcgctgctggagcgcgaccctcatccggacgaagccaccattggcgagcatatggcgagcaacctgtgccgctgcggcacccacctgcggatcatcgacgccatcggtcgcgtggccaggcaagagcggagcgccccatgacccggcacgatgaagtcgaccaggggcgccgcgcgttcctgcgtggtggtgcgctgatactggcgttcaccctggtcccggcggcgcgccaggcgctggccgacagcgaagtcgataccctcggcacgctggtgctggcgcccgatctcccgggcagcctgcgcaccaatccctacctcgatgcctggatccgcgtcgcggccgaaggcgtcaccgtctacaccggcaaggccgaattggggacgggggtgaaaactgcgctgttgcagattgctgccgaacgcctggacctcgcgccaggcgcgatcacgctgcttaccgcggacaccgccctgacgcccaacgaaggctacaccgcaggcagccacagcattttcgacagcggcacggccctgttcaacgccgcggcccaggtccggcaattgctgctggcgtcggcggcacgcagttgggccgtcgacgccgcgctgctgacgacgcacgagggtgtgatccaaggcccggccgggcagcgcatgccctatgccgaggcggtcaagggcgtggacctgcaccactatgcgcaggcgcaatcgccctcgatgccgccgtccgcgttcaagctgatcggccattcgctgcctcgcctggacatcccggccaagatcagtggcggcgccgcgttcgtccaggacctgcgcctgccgggcatgctgcatgcccgggtgatccgcccgccccgccctggctgcgccctggaagccttcgatgccgaggcgatcaaggccctgcccggcgtggtgcgggtggtgcaggacggcaactacctggcggtggtcgcccgggatgagtggcaagccatcaaggcgatgcgcagcggctatgagctggctcgctggagcgccggagaagcgatccccgaagcgcgggatatccacgcgctactgactcgcctgcccgcgcgccgctacccgatcagccatgaaggcaacccggcggccggcgccagcacccgctatcgcgcgcgcttcagcaagcagtacctgatgcacggctccatcggcccgtcctgcgccgtggcctggttcaaggacggcgtgctcacggtctggacccacacccaaggggtctacccgctgcgcgcggggattgccgagatggtcgggctggcaccggagcgggtgcgctgcatccataccgagggctccgggtgctacggccacaacggcgcggacgacgcggcggccgatgccgcgctgatcgcaatgcggctcgccggcacgccggtgcgggtgcagtggatgcgcgagcaggaaaacctctgggagccctacagcagcgccatgctcaccgaggtccaggccagcctcgatgcccagggccgattgcaggactgggcctatgagctgtggaccacgccgcacaacgaacgcatcgtcaatgccggccgcttgattcccgcgcggctgttggcccggccattcgcttccgcgccttcgatccccattgcccagcccgaaggggatggcgatcgcaatgccgtgccgctgtacaccctggcgtccacccgcatcgacatgaacttcgtcacccgcatgccgtttcgcacctccgccatgcgctctctgggggcccacatcaatatcttcgccatcgaagcctgcatcgatgaactggccgcccgggccggcgccgatccggtggccttgcgcctcgcccacctgagcgacccgcgggcacgggcggtggtcgaacgggtgcgggacgccagcggctggccgcacaagggccaggagcccggcgcgggcatcggcttcgcgtttgcccgctacaaaaacatcatgggctactgcgccatcgccgccctgctgcgggtgcatccgcagaccggcgaggtccagctcgatcgagtggtcacagcggtggacgtgggccagatcgtcaaccccgatggcctgcgcaaccaggtggaaggcggcatcgtgcagtccgccagctggaccctgttcgaaaaggtcggctacgacccgggcggtgtgcgcagctacgactggagcggttatccgatcctgcgttttccgcagttgccccagcaggtcgaggtgcatttgctcgatcagccgggacagccgttcctcggcgccgccgagatcgtccagggccccatggccgccgccatcggcaatgccgtggccaatgccaccggccggcgctggctgaacctgcccctgacccgctccgagcagccggcctagcctggagcccggccgccacttcggtggcggtcctttcgcacgctgccaatgtctcgaggatcgagcgggccaatcgccgcgctcaccgtcggctgcccgctcgccgcgccatgcatccgttgcccttcagggcgttgcgtttcacgcaatgcagcgtagagcggcggctggattatcaaccacggcccggcagattaggttagtgcccagcaaagacacgcaatcggcaatcacctgttgttcaaccaggcaccgtccgcctgagcacccaccgcatctcgatcgatgccctcataaggaaatacccatgactcagcacctgttccaaccccttgcggtcggcccctacaccctggctcaccgcgtggccatggcccctctgacccgctcccgcgccggccagccgggcgacctgccgaccgccatgaacgccgagtattaccggcaacgcgcgagtgccgcgctgatcgttaccgaggccacgcagatttcccgccagggccagggctacgcctggaccccgggaatctacagcgatgcccaggtggcggcctggcgtcaggtgagcagccaagtgcacgaagccggcgggctgattttcatgcagctgtggcatgtggggcgtgtctctcacccgagcttccagcccgacaacgccctgccggtggcgcccagcgcactgccggttccaggcaagacctttatcgtcgacgacgagggcaacggcgtctggggcgatgtgccggtgccacgcgccctgcaagtggtggagatcgcgcagatcgtcgacgactatcggcgcgcggcgcgtaacgccctgaaggccggcatggacggcgtggaaatccacgcgggcaacggctacctgctcgaccagttcatcaacagcaacagcaaccagcgcgaggaccagtacggcggcagcgtggaaaatcgcgcccggctgttgctggaagtcgtggaggccgtcgccgatgaggtgggcgccgaacgagtggcggtacgcctcactcccatggggcgcttcatgggcatgggcgacgcaacgcccgaggccaccttcggctatatcgtccgctccctgaaccgctggcccctggcctacctgcaccttgtggaaccggctgtggtcggcaccgtcaaggacgagaacttcgacccgcgctgggacgcgatcatcgggcaactgcgcacggagtggaaaggcgtgctgatgctcgccggcggctacgatccgcaatcggcggagcaggccctggccgccaaccgcgccgacctcattgcctttggccgccccttcctggccaaccccgacctgccccggcggatccgcgacgggctggcgctgaacgtacccgacccaagcactttctttggcggcgaccagcgcggatacatcgactaccccgttcatccataaggagcgatcccggggaccctgctcccgggttcatcgaatcggccgcgcttgcgggggcggccgatacccggcgtgcaaagggcggcttcggcttatcggggctcctcagggccggttccgcctgccgggctggacgcgatagcctgccgaagcgtttccagtgtcgcgggcttgaacagaatctcgtccatgccagcggccttgcagcgctccaccgcactcgcctcgatgctggccgtcagggcaatgatgcgacagcgtcgcaggccgctgtgggactcctcccagcggatccgcctggcgagttcgaagccgtccattctgggcatcatgccgtccgtgagcacgatgtcgaagtccgcgctcagccagcgtttgaaggcttcctgcccgtcttccgcgaccacgactcgatgccccagggtctcaagctgggtgttgagggtgacgcgattgaaggcgttatcttcggccagcaagatggacaatggctgcacttgggcagaaacgggcggctcctgctgcgcagcttcgccctcgacagcggctggagggtcgcagatgggcaggctcaattcgaggctgaagcacgaccctttgccaggttcgctacgcgggttgatcgtgccccccatcagttgcaccaggcggcggctgatgctcagccccaggccacttccggacatctgcccagtgcctggtacgcccacctgggagaagggcttgaacagcttgcccatgtcttcggcgccaataccgatgcccgtatcgatgacatcgaggtccaggcgcaagctgtctccctcacggcgggtgcgggcctgcagggtgacgcctccgcgctcggtgaatttgatggcgttgctgagcaggttgaacagcacctgcttgaaatgcagcgggtccagcagcacccatgcctgcaggtcgccttccaccttgacgtccagggtcaggcctttttgtcgcgccatgcccgccactaccgaggcgacgccttcaatctgttttttgatgagcaccggctcaggaaacgaatcgatctttccagactcgatgcgagaaatatccagcacattgcccagcagcaacaggagcccctggaccgcttcctgggccacggacagggatacgctgtcggcctccccctggttcgctctgcgcagggcgagttcctgcaggccgatgatcgcgttcagcggcgtgcgtatctcatggctcatcgtcgacaggaagacgctcttggcctggttggcggcctcggcccgttcctcggccgcccgggtcctgcggacctggcgtcgcaggtagaaggcccagatcagcgagatggcgatcaggatcgcgaagaggctgcccagctggagaatcttgtcgcgatggtcacgccagaagtcgctcccgcccctggagaaacgcggctcccaggctttgactatttccgcgacctcttcaggcgtgattgccagctgcgccttctccaggatgctgcgcaactccggctggttcttcgccaccccgataccgatgggtgtggaggtgctttgcaggatcccggtgacctggatgcgattgtcgaagtactgggccgacagatagcggccggtgtagtcgctgctcaggtacacctcgttctgccccgaatcgaccgagcgcatggcctcgaggaacgtggggtataccttgagctgaatcgccggatagtcacgtcttatggtatcgatgaaaaagtagccttcacccgtcgccagcgtcttcccattcagatcggcaagcccggtgaaacgcctgccggcgtggcggccagcaccggccgcggtcatcagcacggtggagctgcgcaggtacggcggcaagacatccagtggcgtctcgaacagctcggactgaggcatggccggggtcaacagcacgcgcccctcggcgatgagcttgttggtttcaagggtgtttggcgtgccctggtaggagaacttcaggccgctgcgctggctgatcaactccaggtagtcgcggccaatgccggtgacgtcgcggtcccgtcccagctcgcccagcgccccgagcgagtaattgatggccacgggaacctgcgggtggctgtccagccagcgctgttccgcgggcgccagcttcacccgcgcttcgtcgatgctcaagcggcggccggcgctccagctgcgcaggatgtcgtccccatagcgcttggatatcctggggatcgcccggtcgatgatgcccctcagcggctcgtcgcccggacgcagaaggaagcggaaaccctggctgtcgacaggagcgaagttgtcgatgcgcaggcccagcagataatgggtttgaatcaggtaatgcgaggacagcgcatcccccaacactgcgtcgacatctcccagtaccagcgcttcgagcgcgcgttggggcgagtcgaaaagctcgaccttgctctggggatagacctcccgtaccgcctgttgctgaagatagccgacggtcattcccagaacgctaccggcctggtcgggatcgaagggctgggcctgcgatgtcaccagcaccggccggtcgggcaggtaagcctcgctgagcagcaggccattttcccggccttcgacatcgctgcccacgcccagcaggtcgatctcgccactgcgcaaggccgccagcgcggatgcccgcgacgagtaggcgcgcaccttgggcggccgctcgaacatcagggccagatagtcggcggtgatgccctggtagcggtcgccatagagcactgacaggggcggataatcgagacgcacgacccccaccgtgagcggcccccgcccttccagccactgccgcgccctggcatccagccaggggtgactgctggtggtcatccgaccggacaacgcgatgtcttgcgcgtgagccggaaatatcggtgaaagaaaacccagcaacaggatgccgatagctgcgagggacctcagtagcatgggggaaccttccttgaggtacttgcgggatttgcggcaggtggcgattcgcaggcggtcactgcggcgcggtcgaaaatgtcgtgaactcaactgcaactctaggtcttggtggctttgccgacagcaaataccgcatcgtagaccatcgaggacagggactgacagacgaataccgcacaatgagtaccgctgcttctcgccccctccatgatttatctgaattggtcagcccaattcgccttggcttgacatcccgacgactcggtcaccaacatgcagccgactacacagccatgcacagatatcatgttcgaactgaaagacctgccttcgcgcgaaaccctcgagcacttcggcaagctctatgacaaccccgatgtcgaagggctctatacctggctggtatgggcgtcggcgacggatgaaatgctctcggcgtttaatgccaacctcgcgcacgagaatcttgcacagacaccgttcttcgtcctgttgctgctcaagcgtaaccccgggggactctcgatcggcgcgctggctgatggggtagccgtggcttcgcagacgatgacgcgcgccatcaagcagatggaagctgccggtctttgtacgaaacatccggacccggacgatgggcgctactggatcgtccggctgaccccggagggcgacagcacccttggccgggtgctgcccaaacactacgagtgggttgccaggttcatgcgccacttcaatgaagatgaacgcgagctcctggtgaagctgatgatgagggtggcccctgccctgcggacaatgcgcctggaaacggaactcggctgatcggccgagtcttttgaaaatcatgtagcacgctacacagcaacctacagaaaattaaatattgggcggctccctcgcgtcgcggccagtaacgccgtgacttcaatgccctggcgcctctattgatcgagatatgtagcaatgcacacatctacacaggatatggctcaacaacccacagcgactttgctggtgcagatggtgttctgcgcgctcgccgtggtctctctcttgtatatcccggtgcctatcctgccccttttggcacaggcctatcagttgccgcaggaacaggctggcctcgcactgggagccttcgggttcgcgtacgccacgggttttctggtgttcgggcctttatccgatcgccttggccgcaggacggtcatggtcggcggcctggtgctgctggccatcatcacgctggggctcgcatgggcgcagacgccgaccctgttcatctgcggccgcgcattgcaggggttcgccgccgcctccttcccgcccgtggccctcgcctacttgtccgagcgcggtacccccaagcaacgtgtgtggggagtggcctggatgagtacggcattcctgtcggcaggtttgctcgggcagatctacggcagcctcgttgcggggcgttggggcctgggttacgcccttatgccgctggtggcgatctatgccgcgaccgcgttgcggctggccacagtcccggaaggaactcgagcggcacgtccgatgagctcgatgtgggaaggatatcgacccatcttcaccttgctcggtaacccggccctgcgccgtgtctatctgcccgcgctcctgctgctgatgtcattcgtcgccttttacataggactggatatgcacctgggcgagctcatcgaaagccagggcatcagcaggatgcaggcacgtggcgtggcgttgccggcgtttctcgcgccactgctcgccgccaaattgattggtcgctggggagccaaccgggtcgccaccaccgggctgggcgtcgcggcgcttgggctggtgctctgtgcaagtgcgggtcaagaacacattcccctgctgctggcagccagtgtcgtctatgtcgcgggagtggccatcagtgtccccgggctaatcgctcgaatcgccgcggcggtatcgcccgatgttcgcggcctggcggtgtccttctacaccttcgtgctctttgtcggggcgagccttggaccctggctgggaaacatcagtcgcgcctggcaggtggaatcttttcttctggtactcgcagcggggctcggcgctgcagcgctgtacagcgcagtacgggtagatgacagctcccgtgtgcgctagtcgaccgaccttggtttccacgcaggacgtcagtgggaagtaggtctgttttggtagtaatccggtatcggccaaacgacctgccgaaggccccggatatagaaagggaatccattgatgggtatctacgttgtagttgcaaaccagttcgaagacttcgcaaggcatgaaaacgtgatgtcctacagcacgctgctgcaggtgctgaagacatcgggaccatccgtgctgagaggttgcaaggtcgttgccgggcaggggcttggccgtaaggaaattcagcatgcctatcgcatggcgatcgccagcgggcatgccgatgagttcgatcattgggacctgtggacgggcgcggagctggcgggccaggagctcgcccacaagcgccagcgcaagaacgtgctgatctccgttccggagaggaacgaggaaggcctctataccgccagcctcctgctccatgccgaaaacgagctgatgctcgaccacctcactggacagcatgtgcaaggcatggtgctgctcgaagcgtgccgccagatgttcctggcggtgacggagcgcttccatctggacgactacaaaccgcataaacgctacttcgtcctcaacgagatgaatgtccgctacaccgccttcgccttccccctgccggcgcagatccgctatcgcttgatcgacctgaagcaaccacgccccgaccgcgtcgaagtgcaggcgacgatggaggtctggcagggcgaacaatccgtcactggcgtggatgtcaaattctccgtcatggatgccgaacgcctcggtctgcgcgaggccacgctcgcctctcgcgccctgtcctctcaagtcgacaccttgcgccgccgcttgcgcttggccccgcacccgcatgcgcagttgatgaccgagccgattcccaccctttgatcccatcgcccgcttgcacccaggtgcaagcgcctttcgagtaatcgtaatgaaagcacgaagaatcgctttcttcgacgtcgatgaaaccctcatcgacctcaagagcatgttcagtttccgagcgttctacttccgtcggctatggggagaggaacgtggcggtgaggcagaagttgccgctgccaaacgtatcgatgagtacgtcaggaaaggtttcgatcgctctgccatcaacacgctgttctacgaagacttgcgcgatcaccagcccgaactggtggccgaggcggccctggcctggtacgtacaggaaaggacacgctcggaattcttcatccttccagttctgcgggcacttcaggagcaccagggcaacggagacatcgtcgccttcgtttcaggttcggccgtggagtttctggcgccactggcgaccgagctgggtgtgccccatgttctggcaaatcggctggaaacgcgcgatgggcgctttacgggccggctcatcccaccgcaaaccatcgggctgggcaaacagcaagccgccttgcgcctgatggatacgctcagcgtcgatccagccgactgctacgggtacggcgatcacctgacggacctccccctcctgatgagcatcgggaaacctacggtagtggcgggcgacccggccctggtcaggcatgcggagcaacgtgactggcccatcctctaccccgacgcggccatgcatcgaggagaaccatgatgtcgtttcacccgttctccttcagccgcctggcggtgttggccagccttgccctctggttgagcatcgccgtactcaacaacctcaccgacccggaaaccaaccgcttccatatcggcaacacgctttccatggtgttgctggaagaagaggaactgctgggcgcggccctacgctggcgcgcctggccagcgcactgggccgaaacggcgctgtacgcggtggcaggcatccaggtcgtcgtttcgatgctgctctggtatgcggcattcgcctacgccaaggcttggcgcctgggcagtcgtaccgcgctggacgtcgcccgcaaccgcgccgtcgtcgccctgacctgcttcctgttgctgtggttcggcttcatctgcggaggcctgtggttcggctactggctgaaacagggcgccattcaatcggtgcacatgacgctgattctgataggcctggtggcactgctcttcgttcaaggcgagccccaatcatggccagctgtacagcccgcagcccctgccacgcctggcagtcaaccactcgaaaggagccttccatgaactcgccggtccgcaccgcgagcatagccctcgccatggctctggcagcgatcactgccaccgccaacaccgatttgcccaaggagaaacctgccatgcaccagcccgccacccgcccgatcgcagtgccttccatctaccaggagtccgctcgccgccaggtgactgtcgacggcgagcaagcgctactcacccgctacgtgcgcagcgatggccgcaactcaggactggatggcgaacacttcagcaccgtggtttcggacaccggcgtgctcaagggcttcgccaatatgtcgctggacctggtcggcaagccactgccgtcgcgcgaacgctccgaggaaattgccaggctgtttctccagcagcatgcccccgacctgatcgagcgtatgaagatcagttggatcgaaccccacgatgaaccgttgaaggttacgcgcgacggccacgaagaggtcgtgaccttgagcggcatgaaagtaaaggcacgcaatctggccgacggtcgctggttctggatcatcgtcggcagcgacgggaagcccatggtgttcgaacgcgacatcgtctggatcaccttccccggaaagcgccagaccgagaaatggctgcatgacagctggctggcaaagcaaccaggcgcttgggcccagtcactctgacgctgccgtcagggccagggcgcacatcctgaaccatctttgggagtcaaccatgcgtatctccagttccagcagcatcaagcacgtcttggctctggtcgccgtcagcacgctgggcgcctgcggccagcccaaccagggagcgagtacggaacaaccccttcccgtcgtcagcgtcgcggaggtcgtcgtccagtctctcgccgattgggacgaattctcgggcaggcttcaagccccggagtcagtcgatctacggccacgggtctccgggcatatcgaccgggttttgtttcgagacggctcgctcgtcaagaaaggcgagctgttgttccagatcgaccccaggcccttgcaggcggaggtcagtcgcctcgacgcacaacttcagcaggcccgcgccaaacagacccgcgccgccagtgaagcccagcgcggcgagaagctgagggccaaccaggcgatttccgccgagctggccgacgcgcgcaagacggcgtaccaggaagccagttccgccgttgcggcgatccgcgcccaactcgaggccgcgcgcctgaatctgagcttcactcgcatcacggcgcccatcgacggccgcatcggtcgcgcgcgggtgaccgccgggaacctggtcaatgagggagccacactgctcaccacgctggtgagcacgaaggagctctatgcgtacttcgatatcgatgaagccacctacctgaagcagattcgccgcatacgaagcgaaaaggccttctccccttcccgtgtgccggtgcatttggcgctgagtaccgacgaacgacccgcgtatgaaggtcgcctggacttcctcgacaaccaagtcaatccgcgtaccggtaccctgcaggcacgtgctgtcatcgacaacggcgaaaacgagctgacccccgggctctacgttcgcctgcaattacccgccagcgaccgctaccccgccacgctggtccgagacgaagcgattggcaccgacctgggcaatcgcttcgtactagtgctgggcaaagatgcggtggtgagctatcgcgccgtccagctcggccccaaggtcgaaggcctgcgcgtgatccgcaacggcctgaaggcaggagaccgcatcctggtcaatggcctgcagcatgcccgtcccggtgccagggttgcaccggaaccggtggccatggcgaccgctgaggtgctggcccgtttgacacggctgaatgcctctaccgaaccgacgcctgtcgcacaacaaggcccggcgcggaggacatcgccatgaacatctcgcagttctttgtgcgacgcccgatcttcgccatcgtcctgtcgctgctcattctgatcggcggaatcgtctctctgttccagttgccggtcagcgagtatccggaagtcgtgccgcccactattgtggtgcgggcacaatttccgggcgcgaaccccgacgtgctcggcaagaccgtagcctcaccgctggagcaggccatcaccggcgtggagaacatgctctacatgtcctcccagtcgacctcggacggctcgatgaccctgaccctgaccttcgcgctgggcacggacctcaatgccgcgctggtccaggtgcaaagccgggtcacccgcgcgaccacccagctgcctcccgatgtccagcggctaggcgtgacggtggacaagacgtcgccggcgctggcgcaggtcgttcacctgtattcgccgagcggccagtacgatccgacctatcttgccaattacctgaccattcacgtcatcgacgagctgtacaagatcgagggtgtcagcgacatccgcctgctggggatgggcgattatgccctgcgggtctggctggatccggacaaggtggcctcctacaacctggccgcgacggatgtgatacgcgctatccgcgagcagaaccgggaggtcgccgtcggctcgctcggcgcaccgccaaacgccagcgacaacgccttccagttgctcattaacgcccgaggcaggttggtcgacgaggacgagttcgagcgcatcatcgtgcatgtcggcgagcacggcgaaatcgtccgcctgcgcgacgtcgcacgcatcgaactgggctcgagccagtacgccctgcgcgcgcacctcgacggtcgcccttccaccgccctgcagattttccaggacgcggatgctaacgccatcgagctgtccgaccggattcgcaagcggatgagcgagctcgctcaagacttcccaccgggcgtcgagtactcgatcggctacgatcccacgatcttcgtgcgcagttccatcaccgcggtggtgtatacgctgctggaggccgtcgcgctcgtcgtgctggtggtcatcctctttctgcagacatggcgcgcgtcgatcattccgctagccgcagtgccagtgtccctgatcggcacgctcgcggtcatgcaactgctgggcttttccatcaacgcgctatcgctgttcggcctggtgctggctatcggtatcgtggtcgacgacgccatcgtcgtggtggagaacgtcgagcgcaacatcgacatgggcaagtcgccgatagaagcgacccgccaggccatgaaggaagtgaccggcccggtcatcgccaccgccctggttctatgcgcggtgttcattccgaccgctttcatctccggcctcaccgggcagttctaccggcaattcgcgctcaccatcgcgatatcgacggtgatctcggcgttcaactcgttgaccttgtcgcccgccctggcggcgatactgctcaaaggcaaggacgcgcccaaggatcgtctgtcgaagctgatcgaccgactgttcgggggctggctgttcggtccgttcaaccgactgttccagcgggcaagtgcgggctatgtcagcctcgccacgcgactgctgcgagcaggcgccatcgtcctgatgttgtatgtcggcctggtgggactggcctatctggggctggagaaaacccccacgggcttcatccctcagcaggacaaacagtacctggtcgcctttgcccagttgcccgaaggcgccagcctggaccgcaccgaggccgtcatcctgaagatgtccgagcttgccctgaagcatccgggggtggccaataccgtgagtttcagcggcctgtccatcaacggcttcgtcaacagcgcaagcgcggggctcatgttcatcccgctcaaatccttcgatgaacgcaaggacgcctcgatgtccgacaccgccatcgcccaggccttggccgctgaatatggccggatccaggaggccttcgtgatggtggttcccccaccgccagtggaaagcctgggctctatcgggggcttccgggtgcagatcgaggaccgcggcagcctggggcatgaagcgctctaccagcagattcagtcgctggtggacaaagccagggcgctacccgaactggccggcgtcttctccagctatcaggtgaacgtcccgcagatcgacaccgatatcgatcgggacaaggcaaaggtccatggggtggcgatcgacgaaatcttcgacaccctgcaggtctatctgggctcgatgtatgccaacgacttcaaccgcttcgggcggacctaccacgtcaatgtccaggccgagcaggcataccgcatggcgccggagcagatcggcaggctgaaagtacgcaaccggcagggcgacctcattgcgctgtcgtccttcgtccggatacgggagtcgtccggtcccgaccgagtgatgcattacaacggtttcctgtccgccgagatcaacggcagcccggctccggggtacagctccggccaggcccaggcagccatggagcggctgttgcagcaggaactgcccaacggcatggcctatgagtggaccgagctgacctaccagcagattctcgccggcaataccgccctgctggtttttcccttgtgcgtgctgctggcgttcctggtactggccgcgcagtacgagagctggagcctgccgctggcggtggtgctgatcgtccctatgaccttgctgtcagccatcgccggggtgctgctcaccggcggcgacaacaacatcttcacccagatcagcctgatcgtattggcggggctcgcgtgcaagaacgccatcctgctggtggagtttgcccgggagaaacagcagcagggcctggattgcgtcagtgcagtgctaaaggcctgccatctgcgcttacgcccgattctgatgacctccatcgccttcatcatgggcgtggtgcctttggtgttgtcctccggtgccggcgccgagatgcgccgggccatgggagtcgcggtgttttcggggatggtcggtgtcaccttcttcggcctgctcctgaccccggtcttctatgtatggctgcgtcgcctggtggaaaaacgtacccaacgacgcgcggccatgaagaagatgcgttgggagggcaaaacatgagccgcctgctatcgggctcttggcgaaagctggcagtccagctgaagcagcattttttgtcgaaggagaagtagcgttatgaaagctcttgcagttgcctgtgtgttggcaggcctggtcaatgctctgcccgcatcggcggcagatagcccaatttccggtaatggagaaacctcagtggtcaccagaaaaaactatcccaccctgcccgaaccggccggcccctactccgtttcggttcgtcacaacggcaccctgtacctgtccggcatgacagccttcggtacgcccgcccagggcaaagacatcgccaggcaggccgaagccatattcgaacagatcaagcgcgtcacccaggccgaaggaatcggcatgcgtgacctcatcaaggtgaccatcttcgtgacctcgatggacgaagtcggcgcattgcgtgaagtcctgtcgaaaaactatggcggtgcctacccggccagctcactggtgagggtggccggcttgttctcgccagaggtcaatatcgagatcgaggcagtattcgcagtacctggctgagttcggccatcgaacctgtggctggccctcatcggagaagaggcgccatccctatatcgacgcccactgtgtgccagcaattggcatgcccggcgttcccatgatgaaaacaaggggtagcagatgtctgtttttttggtcacatggaatctcaacaaggaacgcggcaattacgctcaagctcgccaagtattcatccaacatttggatcgctatcagaatgttaaagatcctggactggaatctgttcgctggattagcagtaacgccacagcagcccagatcgatgaagatcttcgacttaaacttgacagcaatgaccgtatcttcgtcaccaaactgaacaaaggggaatatcaaggttggcttaacaaagatgtttgggcctggattgatgcccgactctaacgttgttcagcgtctcgttgcaccttatcgtgcgctaacttagaccctcgggtaggcgctcgatgatcactcagggagaaccagttttgcagtgaggccctgtttcagcaggcttggggacttgtccggagcttcccaagccgttcccggatgcgcgaattgcagttgcgcaggcttcccgaagcaatgccggcaactgcaactcgaacatcttggcgacgagactatcgcactagctgccaaacggtggcatcggtatatcgccaggctgcaaccccagcagcgacatgtactcgtagatgtgctgatagccggattgggctttatagcttgtgcaactggattgcagtttcccacagagccgcagctccatttgtgcgctgcccatgccccattgcgtatagttcaaattattgtttgtaacggtatctattccacggcaaaccgctttcttcgtgtcgtcatcaatgacattggttggttcatagagcgtcaaggagaagtcgagagaagtggcgcaccacgccatcggtatagcatccagagtgttgtatatccgtagcgcattaccggccatttgcttattgaaatagctcgcaaaaaaaccatcgccagccgttggtgcagcaatcgtttcgcaataaaagttaaagcccgagaatttgtctttcagataaagcgcgaccactgacatgagcgccccgccaaggctatgaccgaccaaccggatcgtcgccccgcttcgctgcttccctagaaaatcacacagcgtgccctgagaaccgatcttggatgccgtatgcaatatcgcgtgtacccccccctcagttccctgagatatgttcgccggcaccgggcagctcttgataagtttctgcaacggcaccattggaaaaatatcaagatcgtccagctgatccaggggagaattgagaagggtcccgcttgtcactactacgatgtcgttctcatttttcccgccgatcagcaccactgtgatgtgagccgtgtaatcgccatccatcaccagtgcggggccccaggctacgccatagccgccgcctaccttggagccattaagacgcgaaagaatgttgtctttaacctggcttggtgaagggttcttgatgttttcccaggtcggcgaatacctcgccgcattattgaccacgaaagcgtgtgtaagactgatttgcctttgctgaagtgagtctagcgaagtcatgactgctccttgtctcgaagaaaattttcaagggaccaacgaaaacttatggctgccgtcgatccttccgggccagcaagatcgagtgtagtcgcagttttggaagcgtgagtacggtgcactggacgaatgcatcgccgcaattcgccccgatggccaagggtcagagggctgccctgcggcagtgcctattcgctaagttctgtacgcaaagtaacgtcgcaaacaccgcatggctcaaactaaagaggccatcgctgcatagctttctgcaagtttgtcgacgcgatgcgctcaaccctgctcgttcaacttgatgggcagccactggagtagccatcggtcggccacttcgtcggggctgttcgaagatattcagcaacccgctccccagccgcatcggggattcgtaccgttttgccatcgtggcctactgctgaaccccggcgctcaagtgcggcagcggcttcaaagaatttcgtacagagcctaaaacgggaaacaacagggcaaaaaaaggactttccaacttgtgtcgccatcacatcgctcaacgcggggctgacatactgctgttggtaggtgagttgcaccttctggtacttcatcaacttggggtcgattgaggatcgatctgacagtcaaaactagagagcctagcaactgtcagatcaggcccgcacttctacacaatgcgttaaatcgtaagtaccgaacgaaatttcgctttgcccatattcaggaagacttcctctgcgtcttcaagcggataggtttcaatcattgcccgcacccccttgagcgccgcaaacgccatagtttcctcgctgtctttggcattgccactataccaaccagcgatactacgccgaccaaataccagtaagtcaggggaaacacccagaggctgatggtcggtcgctacaaacacaagacgaccattaggcttgagacccaaggtcagatccgcttgtgccgcgcttgatcctaccgttgagagcactactgtcgctccacctaaacgtgccagggcctctcctgcactcccctcagtactgtcgatgtattcgtcagctccaagcttgcgggccagggcttccttggcgcgaccacggctcaccgctaccgtgcggaaccccattttatttgcaaactgaacggcaagatggcctaaccctcccacgccatgaattgcaactgtatcgcccggacgagcgccagaatgacgtaacgcgttgaatgttgtaatacccgcacacatcagcggagcagcctcagcaaaagacagcacattgggaatccgcgctagagcatcttgcggtaccaccatatattcggcataccctccatcgtaactcgcccccacgatcatacggtcgatgcagttggtgaagtcgccctgacggcaatactcacagttaaaacaactccccccgtgccagccaactcccacacggtctccaggtttccaggtcgtcacctcggcgcctaccgagtcgatctcaccggccacttcatgcccaggtactcggggataagtcacacccagcatgcccattcgagcaatattttccccagcacagacgccacacgcatgtactttgaccctaacctgtcctggaccaggtacgggtacgggaatctgggacacgacgaaagttccacctacctctacggcctgtaccgccttcattagcattgtctcagtcattacacacctcccaattagagggcaatagaaaccggatgcggtttcgtttgcccgattcagttgcttgagccgccattcatcagaatctcttcaccggtaatgaagaacgattggtcgctggcgagaaattccgcgatatcttgtgcctttgcgagcctcccaatcgggatcgtctcgagcaaactctttttgtaaggatcgtcgtcaccgactccggtgaaaatgccggcgccgtcgatcgggccagggacaagtgaattgacggtgactttgcgatgaccgatttcctgggctaacacccgcacgagatatttcggcgcggatttgctagtcccgtaaagaccaagtcctggttgcgggcgcgatgtcgagctggaggcaatattgatgattcggccgccatcagcgatgtggcgagctgcagcctgcatgacgaagtagggacccttggtgttaacccgaaagagtagatcaaagtcctcctcggtcacgtcgaccacctgaatgttgaccttttctatgcccgcgttggccacgacaatatcgattttgccgaatgccctgagcccggcctgaaacaacgcttcaatttcaacaacgttggacacatctgcttgtacgctggatcgccttgacaccttcagctatcgccgcagccactacttcatcagcaggtgctttgtctctcgagtaattgatcacgacattggcaccgcgttcggccaggcgtagcgcaatggcgcgcccgagccccttggacgaccccgtgactattgcaacttttccttgcaaattcatgactgcatactcctgttaattaactgcgttgaataaaactggaggcgtggggtatgtgagtgtattcgacgaagtcgtcgatcacggtcatcctgtttacagctagatagtcctctatgtctgaagattaagtgtaattaatcggacctcaatggaaagcccataaaatccagacaaacaatccaggaaaaacatccaatcccttgcggatactgcttgtacagcttggcaaccgtttctgacttcgaggcgtcaagttctatgacctcaacttgataggctggttgatagatcgctttattcgaagtggcaaacctctccgtgtttgttcgtctctgaacatcagaatcagcaagtgtctatcggtctggataacggccacggcgactgacactcctcctgcacatatatagaggagacgaccacatcgatccgaccaccctccaggacttcaacttcgatacaaatattgcgcccttgcatagcgcctccgacattggcgaagtactggaggtcaagctgatgaccggccatagttataacgtggaggtggccagtaacttcattctgcccaatctgatcaaggccgaggcaaagtccgcgccgcgagtggcggatgctgaacgaacatgagcggatcagagcgaatccggagcctcaagagatgacagcatcaacacctcaaaccattcgatgaacgcattgagccgacgcgagcgttggcgtcgatgtgggtacaacagcgagacaggcatcgacgcggcccgaaactcgggcatgacttccaccagttgcctggaatcaagcaggtgctgcacatcgaaccgggggatctgaatcaaccccattcccgccatgcagcaggcgatatagctctcggcgttattgacgatcacccagctgggtactgccacctcatgggtcttgccatcgcttacatactcccaaggtagctcacgaccgttattcggcgaggcataccctaccgagaaatgcccatgtgtcaggtctcccggctccttcggggtgccatgctggcgaagataatcaacggaggcacagttgatcagcgcgatatgcccgatcgtccgggcgaacagactgctgtcgagcagatgaccaacgcggacgacgcagtcgaccccttcctgcaccagatcgatagcgcgatctgtggagcccaaggcgagctgcagctctggatagctgcgcttgagagtcggcagggccggtgcgatcagccttcgggcgatacggctgggaacattgatgttcaagcgtccagagacctggtgttgatgcagctgaaacagccgctggatgtcgtcagcatccgccagtagccgtcgtacccgctccagcaactgagtgccatcggcggtcaattgcacccgtcgtgtcgttcgatgcaatagccgtacgcccagatctgtctccaactcctgaatagcggcagataccgaagcccgcggcaattcgagcatgtgggccgccttgatgaagctgcccatttcggaggcctggatgaaaatacggtactggataagcttgtccataataatgcctaaccggcgaagcccccctcctccagaaaacgcttttcctcaggcgtactctcgcgtccgagtagccgattgcgatgggggaaacgagcaaatcggcggatgacatcccgatgcccttcggcatgggcgagccagggttgccccaatcgagtattgagcaggaccgaaaaatcctggtcgacgaggtcctcggaatgggcaaagggcaggcagaagaacagcctcagatcagcatcgaccgcctccatatgccccgctgcctgcgccaggcgggcgacatgtcgggcctgggtgtccgttgcgtacatgtccgcggtgccacgaaaggcgttgcgcggaaactggtcgagcaggatcagcagcgccagcgcgccctcgggggtatccagccaagcgtcgcgttcaccgcgaaccaccgaccgatgcaggtcgagaaaacgttcgcgaaagcgtcggtcgaacgctgggtccttggcgaaccactgactggcgcccgcctcccgccagaaccggacgacggcagttgcctgcgtgtcgatgatagaggccatgatcatcggtccttggcgaccgcattgcccaggatcatggacttgccggcataaataccacccgctacttccagtgccaggcgctcggcgtccttgcggcgtagatcggcggcaatctcctcggccccatcgggtgtcgcgcccagcaccttcgatgcctcttgcccaaaggtcatggccgactcgaaggtgacgcggatctggtaatccacatcggcgttgatcagttcgatagcgtgctcccggtcgagtgcgcgtgccagcacacgggcatgggggaaccgggtcttggcatactcgacgattcgcgtggcggccttgcggtcgtcgacgcataccaggatggcgcgggcgtggtgcgccccggcggcatgcaatatgtcggggtaggtgccgtcgccgtagtacaccttgaagccgaaatccttggcgtcgcgtataacctgaggctggttgtcgatgatggagatatcggcgcccatcgccagcacatgctgactcacgatctgcccaaaacggccaaagccgatgatcagcacgctgccggccagattctccggcacctgcgtgccttccagggagcctccgtgcttgggtccccaacgccggtagacgatgaccaccaacggcgtcagtgccatggagagcacaaccacggcagtcatgttggcgttgacctgcggggctatcaccccactggccaaggcggcgccaaagagcacaaaggcgaactcaccgccctgggccatcagcacggcccggtccagggcatcggcgtgggaactcctcgtcagccgcgccaggctgtagatacacagtgacttgacggccatcatcgccagcacgccggcgacgatgagcggccaattgcgtgcaaccaccgtcaagtccagcgacatcccgacgcccaggaagaacagccccagcaataaaccacggaagggttcgatatccgcctcgagctggtgacggaaagtcgactccgacaacagcaccccggcgaggaaggcccccatggccatggacagaccgcccagttgcatcaacagtgccgcgcccagcaccaccagcaatgcggccgcggtcatcacctcgcgcgccctggagttggccaggatgtaaaacaacgggttgagcagccaggtccccacggcgaccagcgccgcgagtgaacctgccgcgatgccgatactggcccagcgcgagtcggcaaccggcgcagaaggatcgagaggggcgataaacgccaccagcgccaacagcggtacgatcaacaggtcttcgaaaagcagtatcgccacgactttctgcccacgtgctgcggcaatgtcgccacgctcgcccaacaactgcatgacgatggcggtggacgtgagcacaaagcccatcgcgctgacgaaagacaccgccagcggaaaaccgaacgccaaccctaccccggtcagcaacacaccgcaggtcagtgtctgcagactgcccaggccgaagatgtcgcgccgcatgctccacagatgagaggggcgcatttccagcccgatgacaaagagaaacatcaccacccctaactcggcggtgtgcaagatggtctgcgggtcgttgaacaggcccagcccgaagggaccgatcaccagccccgccgccagatagcccagtacggagcccaggcccaggcgtttgaacaggggcactgccaccaccgccgcccccagtaaggtcacgaccttgaccagatcacccgcgctgccctctaccgacataaatgaatctcccgtatccaaggcatgtcaggcacgggcgaactgccagagagcaatgcccgcggccagggtaggcatggcgaagaccagcaacaggataggcaactcttggcgcacgctataacccgcgtaggtgacacccacccacatattgatgcctgccatcagcagccagaaagggacaaaggccttggccgccagtgccatgcccaggctgtccccgccccaaagccagccgaacagaataaacaccaacagaaggagcagacctcccgccatgaccatcagtacatgcatgtccaacctcctggttcgcgcaacgtcaggctgggcaaaacgccctgccccgacaagcctcgcgcaataagcaaaaaacgctgttgcgcctcgcgggcacaggcgaaaataccgatgttgagaaggcacaaaccgcccatgcatcgggcgcgctgtcctgcatgggcaatcgaaagggagccgcggcgcttcgcgtagaatcgcccccctgcaagactgtgccctaccgcaggaaccgcgacgacagccccataggcgtacagctctgttgcagtcaagcgaaaccctctggttcaggtcgcgtgcaagcagaccacccaagaccctggcctcactaccggcgagaaatacaattgctccagtgacagaatggcgaccatgggaaatatccgccctgcctgctggatagcgttgaagtctaggtaagagggactgacagataaactcgtccaatctggatagacaatcccaaaattccgcccagttcaaactgcctttttcataaaggacaacaacttgatgtcagccatatgtcatcgagcatttttctgtttggctatcggccaccgtgcccgccactgcgcacagtaatcagcggtgacatgttgtactcgccgatccagattccattttggcaatggaggacgctttcgggatgacaaccaagcgacgcccttcctcgtataatccgcactctcggattcgaccctccttgcacaaggtgatctgatgacgaacgaagagctgcaggcgatcggtgactacgtaatgccggagataccggccacccgttccgatctggcgttgatctttggcacgcggcacggcgttgaagagttctgtgcggcgatcgctaccctgtggcacgctcagatgtttctgcgggctatcgtctcgggcggccaaactggagaatgctccaccatcgaggcgcgcgtcatcgcgagccggctgatggaactcggcattccggagaccgccctcctcatagagcccgcagccatgaacaccggcgagaacgttcgctttgcgcgtgcgctggcgcaatcgcaacttgctcccgaagagcggcgcagcgtccttgccgtcggcaaggtttgctcggcgcggcgatacctgatgacgctgcggcgccactggcccgaaccctcgataagtgcgcggtggatcaattatttccgcgtcgacaaatccagttggcatcaagaccctgagttctacgcgcgagtgctgggtgagtatcgaaagattcctggctacatcgacagcggactcctgcgggagcttgaagagcttgggccgtatccagcaattcctggttcaagcctggatcgcatcgatccagcgaaatcgaatccgccgacaacagagccgggttccgtcatctgacagaaatacttgtcgacatcttggcatcaccaactggcgtgcaggcagcacgacgtcctgaaaagacgcagtccgcggcggagaaccccctcacaacttccagcaagataggaaggtcaagttggtatgtgacgataaggccgtgccagtgatggacctcttgcacgcctggatgatcgcccagagccagctcgtacacggcgactcggttattagcaaagcgctggattacagtctcaaatgctacgaacttattacaatcgtttaacccattacccttcatctcgattcaacgggcaagtgatattaccaagtcgccaccctcatagatgggagccggtttaagtgtgcgggaccggatattcggaggcatacttccattgttcagaaatcaaggattgtctatccataaatgactagcttatttttaaattcgaacgttttaaagtaagcgatatctcctgcctccaggagcaggccatgtagcaggctaccctatcaagagtgaaattgttttcatcgacgagggaacagaaaacaggtggattgattcctcgcgacttggcacaacagggaagcacactagtgatttactgcaacagcgcatcgagtaaaagcgatccaggtacgactatttgttgggatcaaagccttggatgccgaagtggtatcccaggcaaaacctgctctatcgtcacctcatgctttggcgctttgtaggcacgtctattgtcttacagttatctggtcatcacccgttgattccgagttgcaggcacatgcttggctttaataccaccacgttacccgctcgagtaaccaggccgtagggtgcctacttctactatatccacgccactcttgccaccggcatcatcgctacagccgtaggtgagattgctccatatttttccgtccaataaagagggaatatcatggctaagattaaagttaatggagattggcgagaagttgatgcctcgaatggtcgccctcttttatgggcattacgtgaagacttgcaactcacgggaaccaagtttggttgcggtgcggcgctgtgcggtgcctgcaccgtgcttctcgatggcatacccgttagatcctgcgtgacgcctgccgaagttgtgacaggcaggtccatcaccaccatcgaagcgatggggagttctaatattggcaagcgtgtgcagaaggcatggacggacctcaatgtcccccaatgcggttactgtcaatcgggtcaagtaatggccgcggtggcattacttacacaaataccgaagcccaccgacactgatattgatcaggccatgtcaggcaacatctgtcgatgtgggatgtacccgcgtattcgggcagccattcaccagattgcggagagcctggcatgaaacgcattctggatacctttggaacgaagcactctgcctcagtcacaggccttagtcggcgacattttcttcaattaagcgcaattgccggtggcgggatcatggtgggttttcatttacccgaagtgatggcaggtacccctgtacagatgccccataaaaccgtgcagcctaatgcttttgtacgtatcacccctgacaactggatcacggtaattgtgggtcataccgaaatggggcaaggcgtcacaaccataatcccaatgctggttgccgaggaaatggacgctgattggcaacgtgtgcgttgggagcaggcacccacggcacccgcctatcagaaccctctaatgcatcagcaacttacgggtggcagcctgacgacaatcgcccaatacgagcctcagcgtaaagccggtgccgctgtccgcgaagtgatgctagctgccgccgcaaagcgctggcacgtcgatgtgtcatcactgcgtaccgacaccggccgcgtgatccacgacgcgagcgatcgtagtgccacttacggtgagctagcagtcgatgccgtgggtattgagccgccagcaaatccaaagctcaaggacccgaagaacttcaagatcatcggcaaaccactccgtcgtatcgacgccatgaccaaggtcgacggttcgggcaagtttggcatggatgcctatatacctggcatgctcatcgcggtgctcgcgcgcccgccgcttttcggcggcaaaatctcacacgtcgacgccacagtggccaaggctatgcccaatgtcgtcggtgtctatgaaacgccgcagggggtcgctgtggtggccaaggatttctggtcggcaaaacgagctcgtgatgccctcgttctgatgtatagcgatgtgaatggcgagcgcgtttcgacggatgaacagcgccttatgtatcgtcatctgatgtcacttgaaggaacggtggcacgtagcactggcgatataggattggcacaacggagcgccgcgaaaacattcaccgctgactactggtttccttacctcactcacgcgccgatggagccactcaatgccaccatcgattatcgcggaggaaacactgctgaagtgtggatgagcacgcaatggcccgaaggtgaccaacatgcggcggcctcggtacttgggctgaaaccggagcaggtaaaactcaataccctgttgaccggcggtggatttggtcgacgctcttcgctcggtttcgacgtcatcatcgcggccgcgcacatcgccaaggcagttcgtcggccggtcaagatgatctggacacgcgatcaagatatccagggcggttattatcgtcccagtgcctaccatcggctcagtgcgactcttgactctcagggcactattacctcttggaccaaccgtatcgccgtgcagtcgatcggtaccggcacagtgatggaacgcttcattgtcaaaaacggcattgactcgctctcggttgaaggagctgaagatattccttacgccatcccgaatctgcgagtcgacttgcacacgccacgcttccaggttcccgtattgtggatgcgctcagtggggcactcgcatacagccttcgccgttgagcactttcttgaagagattgcgcatgggacaggcaaggatccttaccaaatgcgtcgtgaactgctgcaagaaaagccgcgtcaccttgccacactcgatgcagtggccaagttggccaattggtcgacgcaaccgaaagcaggcgtattccgaggcattgtggtccacgagtcatacggtagttttgtagggaccgtggtcgaggctagcgttgcgactgatcaaacgcttaccgtgcataaggtgtactccgtcattgactgcggcgtggcggtgaatcccgacctggtcaaggcgcagatggagtcgagcattgcttttggtctctcgtccgcgctgtacggcgaaattaccctgaacaaaggcgaggtacagcagggcaactacgatgactatccagtcgtccgcatgagtcagatgccgcagatcgaaacgatggtagtagaaagcgccgagtctcccggtggcgctggggagcctggcgttgctggcgtggctccagcgctggccaacgcaatcctatgggcgaccgggcagccagtacgatcgctaccgctacgccattcctttcgtgttgtctaaggtaacctgacatgtacatcacaagagcgacgattctgcggctgtctgccgcgctgagtattatgtcattcgacgcaaaggctcaggagcccaacgcttatcaattgttcgatccagtcgtgagcgtcttacaaagcccccgctgtatgaactgccatcagagtgcacggccgacccaaaaagattcgatgattgctcatatccagaatgtagtgcgtggcacggccggtctgggagcacccacgatgcaatgtattgcctgccatcaagagaagaacaccgccgacggcaaggtgccaggtgctcgcgggtggcatatgccaccgttgcctatggtctgggaggggctgaccagtgcgcagatatgccatcaaatgcaggaccccaaacgcaatggcaatcgtaaaacacccgaagaagtcatcgaacatatgagaaccgatccgctggtgctatgggcttgggatcccggtgctggtcgatccacgccaagcatcacacatgatcagtttatcgagcgattggaactctgggccaaggctgggatgccatgcccggacgaacaagcagcgacacgctgagcgtgacgatcaacacatgacgacgctgctggttaacgtcttggcctatcgacgtctgcgactcaaggcacgctgcgctggagagcgagatccatacccgccgcgtggtctgtgtgattgactgcggcactccgttaaccaaaagagcgacggccgaatggttggatatcccgaacattttgagtcgggagttcgatgtgccggcacccaaccaggtgtggtgcggggacatcacttacatcttggcccaggataaatgacactatctggcggttgtgctggatccgcaggacctactgtttcactcggatcaggggtcaaagcgccggattaatgtactaaaaaatgtactaaaaaatcgtggctgctaatactttcgagaaaaacttactggaacgaaaaaagaggccgaagcctcttttttcattttctgcagacctcaatagaagcctgtagaacaatatttggagcgggaaacgagactcgaactcgcgaccccgaccttggcaaggtcgtgctctaccaactgagctattcccgcgtcttggtggtgtgcattctatagaaattcgaaactgcgtcaaccccttgattcaaaaaagttttatttcttttccacatcggtcttcaggtgcggccaggcggcgcgcaggtactgcagcatggaccacagggtcaggcctcccgcgatcagcaacaaggcataacccagcagcacccagaaggtgaaggccggcgggttggccagcaggatcaccagcgccagcatctgcgcggcggttttccatttgcccatgttggacaccgccacttgcgcgcgggcacccagttcggccatccactcgcggagggcggaaacgacgatttcacgtccgatgatcaccgccgccggcagggtcagccacaggttgccgtgctcttgcaccagcagcaccagggccaccgccaccatcaacttgtcggccaccggatcgaggaaggccccgaacggtgtgctttgctccaggcgtcgcgccaggtagccatcgagccagtcggtggccgcggcgaacgcgaagacggaactggcggccatgtagctccaggagtaaggcaggtaaaacagcaaaatgaagatcgggatgagcagaacgcgtagaacggtgatcagattagggatattcatcggcacaactggctacgaggtgagttggcaatctactcgaaaaagacagcagatgagctaggcacggccattctacgggcttctcgcacagcgtgtctaacactgttccaacacgtcgagcccctcgaaagcgcaacttcctggggcctgcgcgcgcagtatcagactcagttcgcaagtctgctggaaccctcgtatgtagacgtagtgcggtggccatgcagattttccagccagactctcagacctcgctagactctatccaagttcagaatcgtcctaaagccttgcccatcgccgcttgctaggtttgcggggctctacaaagagcctcgcggatcagtcaacgcagggacgataaaatgctctcttctgctcgcctgggcgacaaacacgtatgccctcttcccggtcacggcaccactcttattgcttccgcttctggtgacatcaacatcaacttcatgggagcagcccgagtcggtgacacttgcggttgtggcgcagtcatcaccacggggtttccctcgatcatcctgaatggccgccctatggcccacttagggagcccgaccagtcacggtgggacaatcattacggggtcgggtgacaccttcggtggctttgtcatggtccccactcctgacgcggcaatcattaacttcgcaaccctcggtgtgtttcgcccagacggctcggtagacgatgaaaagatggcgaccttgctggccgacccgaggctgaccgagaaggcgactgctgcaaatgccttgattgatcccaatgcgacctctaaggcgcctgaagagcagccagaggagaaggcctgtaccgaccccgaccgcatggaggaactggcgagctacattgcgggcgagatgaataccaatatcaacagcccgtctgtgcgacagatgaaggatttgaataactttgacccagcaatggaaacacgaaaatacgctgagcttccgttctacatgcggctcggtcccggcccagacttctacagtttggcgctcggaaagaaagccaaggcttttgctatctggactgagcgagtggggcagaaccggccttgggaccacaagccaaagctgaaaaatctctttggtgaatacccttggcataagcaaggtgcctatgaatatttctacgatatctggtcgaacatccactacggatatgttggtgtcgcaggtgggctttctgagagtgtcttattggacggtgctggtgtagagcaaattggatcagacacttggcgcttcatcaaaaaccctaagagatttgatggcccgcaaaggacccagggtgttgaaggtatgcgcgcatgggatgatgtacccgacagggtctcgattattatcgggatgagcctatacaaggaatatccaaatggcggcctcacagggaaaatcattatggacaaagtgttggcagtacccataagcgactgggcgaaaggagttcaaccacatgtctgcaagtgagaaaaagcgctacttagggcggtggattacaggattcgtttgcgtcctcattgcatgctggtatttggctttgccaagggtcgtcatttactactcagacgatggctcaaaagaactcaaatacgtcttcaatacgcagcattcaatatttcgacgagacttgatgccgggtgagacaaccggtgatgcagggcatattttccccgataaggatttctttatgatgttcgattggtgggccgatacgaccccggcccgttgcatctacatcacgccaaaacggtggagaacaatgggcatttaccttgatgggagcgctaagatcgacatcacgaaaacagcccctgatgttattgcccgtctgaaacagtgccccggtcagcccgaccctttccgcccctaaactctcccctactcgctatgcaagttcgcataaatcagttcagcgagctttttactgatccccggcgccttggcgatctcctcaatgctggcgcgagacagttcctgcaatccgccaaagtgttcagcaggtcgcggcggcgcttggggccgacgccggccacgccttcgagggtcgaggtgcggcgggtcttgccgcggcgcgcgcggtggccagtgatggcgaaacggtgagcctcgtcgcggatctgctggatcaggtgcagcgccggtgagtcgcccttgagggtgaactcatgggccgcatcgttgagatagagagtctcgaagccggccttgcgcgtcgcgcccttggccacccccagcaggatcaggtcgggcaccgccagctcgttgagcacatcgcgggccatggatagctggcccttgccgccgtccaccaacaggatgtccggcagtttgccctcgccgtccttgagtttgctgaagcgtcgggtcagggcctggtgcatcgccgcatagtcgtcgccggcggtgacgccttcgatgttgtagcgccggtaatcggacttcagtggaccttccgggccaaataccacgcaggacgccacggtcgcctcgccgctggagtgactgatgtcgtaacactccaggcgttgcggcggctcgtccaggttcagcacttcggccagggcttcgaaacgtgcggccacatgctgccgattggccagccgcgcgctcagggcctgctcggcgttggtcaccgccagttgctgccagcgcgcccgcgtgccgcgcacccggtggctgatgctcagctcacggccgcgcaaggcctggatcgcggtgatcagggtcgggaaatcttcatggaccacgttgacgatcaactcgctgggcaggtcgcgctccgggctgctgagaaagtactggccaaggaatgccgacatgacctcggccacctcttcctcgatacccacctggggaaagaagttcttgctgcccagcacccggccgccacgcacgctgatcaggtgcacgcaggcaccgcccgggttgacgaaagccgccaccacatcgacgtcgccgctgccgccttccatgctctgctggtcctgcacccgccgcagcagggaaatctggtcgcgcagctcggcggccttctcgaaatccagggtgctggccgcctgctccatgccggccgacagttcgtcggtcagggcattgctgcggccttcgaggaacatcaccgagtggcgcacatcctcggcgtacacctcggcctccaccaggccgacacacggtgccttgcagcgcttgatctgatattgcaggcacggccgggtgcggttcttgtagtagctgtcctcgcactggcggaccatgaaggtcttttgcagcaggctcaggctctcgcgaatcgccccggcgctggggtacgggccgaagtacttgcccttctgcttcttcgccccacgatggatgctgaaacgcggaaactcgccgtccgacagaaacacatagggataggacttatcgtcgcgcaacaggatgttgtacggcggccgccactccttgatcagcgtctgctccagcagcagggcttcggtttcgttggcggtgatggtggtttcgatctgtgcgatgcgccccaccagggcagcagtcttcggcgccaggccggttttgcgaaagtagctggccaggcggctcttcaggttcttggctttaccgacgtaaagcagacgtgcatcgccgtcgaacatgcgatacacgccaggacggccactgcaggtggaaagaaaagcactgggatcaaacgggtcggtcattgtcaggcgctggcatcgaccatgccgtggcgaaccgccagcaacgtcagttcgacatcactgctgatcgagagcttctcgaagatacggtaacggtaggtattcacggttttcggagacaggcacagcttgtcggagatgatctgcactttctggcagccgacaatcatcagtgcaatctggatctcgcgctccgacaaggcgtcgaacggtgaatcactggacggctggaatgacttgaacaccagttgctgggcaatctgcgggctgatgtaacgctggccggcaaacaccagacggatggcctgcaccatttcgttgagacccgcgcccttggtcaggtaacccgccgcgctggcttgcagcaagcgagtcgggaacggatcttcttcacacacggtgacggccacgactttgatatccgggtgactgcgcaataacttgcgcgtggcttcaagaccgccgatcccgggcatcttgacgtccatgaggaccacatcgggtttcaattcccgggccttgatcagggattcctccccagactcggcctgaccgaccacttgcaggccatcgatgtcagccagcattcgtgtaatacctgtacgaacgagatcatggtcatcgactactagcaccctaatcaagcagacacctcgcgatttggtcttataggttgccggacaccttagcaaaaaagcagcgtgctgacctaatgacaaacaccatataaaaagcacttgttcaccaggggtgtccggtggatggttgatgcgctgcgaacgccctgccctaaggctctcgggcgtccgcctttcttttcatgaggctggaaaccgaaagctcggcaagggtatgggtcaggtgccggatcgcgtcctgatcttccttgtacaaagcccgataactgacgaggattttctcttcgctctggctgaggttatcggccctggtcggggttcgcctgccggtcactatataaaggacatcgaccccttttgccgccacccgggacaagtaatccgccttgggcacacggtctccattttcatatctgccttgggcattggcttccacgccgccaacttcaccaaattttttctgcgacaaccccaggcgttccctttcctgtcttaaccgcgaaccgattccactcatttggatgtatgatccttttttatgcacccctaggggtgttacacccttcaagcattgaacaaatttgaacggttttgaactatgcccggtatccgcactgccgcacaagccaaggcctggcttgaacatcaaggtaaatcggttcaacagttcgcccgtgaacacggggtcgacccagccaccacctatcaggtattggccggccgcaagaaaggacgacgcggagaggcgcacaaggtggccgtattgctgggtatgaaagacggcatcatccttgccgagccggagggtcccgatcaggcgcccgcctgatcctcgactgtcgccacactgctcgggacgaccgccgccccgcacaaaaaccagcggctacgcatccgcggcgctgcttcgctccatccgtagaaagcactcgtcttccccgaccaccttcagccccatgcgcccatagagcgcctgcgccgggttgtccttgaacaccgtcagccgcagcagcccgcgccgttcgccgcgcgccatcgcccgcacctgttcgatggcccaggccccggcaccctgcccgcgaaacgcctcgagcacatgcaactcgcgaatatacaaggccctggaatcgcgactgaggctgacgaaccccagcacctcggcgccctggcagatcagcaggttctcccgcccggcccaggccacatcgaaggcttcgtccagccacaacaggtcgtgacggatgtagtagcccagcatggtgctgcgggtcaggtcgcgggcgaacagcagatcctccggggtgttggccggacgcagttggaaactgttcaaggcgcttcgaccgtcacttgttgaccactccagcgaccggcgtcgcgccgggcgatcagcaactcatcgccagtgcccgccgcgactacgatcaacccgccatccggcccccagatcgcgctgcggcccgccgacacccagcccccggtcggtccgccgtggttggccatcagcaccagcattgcatgctccaccgcgtacccctgcaacaaggcactgtccgcggcgtagccgttttcgctgatcagcacgccggcggcatagatgccggcaccggactgcgccgccgcccgcgcgtggctggcctgggagaaatcggcgcacaccgccagggccacccggtcctcggcgaagctcaggttcgcgccacccgtgccagggctgaacacctgctcctcgccggcatgcagatgctgcttgctatagaccgccaacgaaccatcggccgccagcaccagggcgccgatcaacagcgggccctcggccgacaggcgaatgggcatgcccaccaccgccgtcacccccaactcccgggccaggtcgcgcaacggttgcaacaacgggctctggggcaagaccgccagctcggccgccagcgtgggctcgtaaccggtcagggacagctcgggaaacaccagcaattgcacgccctgctccgccgcggcgcggataaaggcctggtgccgggcgatattgcccggcaggtctccggcaacggaaatcgattgggcggcggcaagggtcagggaggtcatgattcatcctgaatgagcacaaatgagggcgtggcgagtgtgtcataaaacttcaaagcgcttaactcataggcacttactggtcatgtaataggaatttccgattgaaccgccaccccggcctctagtaagctcggcccacttcacggagaaacagcatgtcgtccctcaccctttccatgcatcgtcacactgccaacgcctcgcgcgtcggtgcggctgcctgggtgaaaaacgcctgcgctccggcgagcttttattttgggtattggtttagccactggcgcgcctgatacccaaacggcgcccacttgaacgggtcgcctaccagagaaaatctcacccccggtcggcctcccgaccgggggttttgtttttctgggccaacgatttttaaccacgactttcagcaacacaccgaacttaccgaggattgaaaccatgaactacgccacctattaccgttacgacacttgcaccacctggcgatttagcagcctccgttcgggacagcctgccgcctccgatcggtcacctactggtggcaaacacacctgcacagccaatccggccaattgtcgaacaccccagtagggccgcgcgcgggacactacccgccgcctgcccaggaagccttgaacatgaactcgtccgtctccgctctgccgctgtccacccgcaactgcgccaacgaaaccctgagccagcgcctgcccagctcgctggagctcaagcagcaactgccgctcagcccggccctcggccagcaagtcgccgcccatcgccaggcggtgcgcgccatcctcaacggtgaagactcccgtttgctggtcgtcgtcggcccctgctcgatccacgatccccagtccgccctggaatacgccagcaacctggccagcctggccgccgaagtcagcgacgacctgctgctggtgatgcgcgcctacgtcgaaaaaccgcgcaccaccgtcggctggaaaggcctggcctacgacccacgcctggatggcagcgacgacatggccggtggcctgaccctgtcccgtgaattgatgcgcgaaatcctccgcctgggcctgccgatcgccaccgagctgctgcaacccatggccgcgggctacttcgacgacctgctgagctgggtcgccattggcgcgcgcaccaccgaatcgcagatccaccgggaaatggccagcggcctgggcatgcccgtgggcttcaagaacggcacggacggcggcgtcggcatcgcctgcgacgccatgcgctcggcagcgcacccgcaccgccacttcggcgtcgacagccagggccatccggcggtgatccagaccccgggcaaccccgacactcacctggtgctgcgtggcggccatcgcggcccgaactacgatcgccagagcgtggcccaggtccagcacgacctgcagaaactgaagatcccggcgcggatcatggtcgattgcagccatgccaacagcggcaaggacccgttgcgccaaccggcggtgttcggcgaggtcctggaacagcgcctgcagggcgattcgtccctggtcggggtgatgctggagagccatctgttcgagggttgccaacccctgagcccgacgctgcgctacggggtttcggtgacggacggttgcctgggctgggacgccaccgagcagttgctgcgcaatgccgcccggcaactgcgcaacagccggcaagacattccggcttccgcctgaacctgcaccgtaggagcgaggcttgcccgcgatgaacgataacgaggtgtaactgacctttcgcatcgcctatatcgcgagcaagagctgggcctgtagccgctgccgcaggctgcgatcggggcgcagccccgtaaacctgaggatgcggcatacctgggctgcgcgctcgtccggccaggcgaccgccgggcggtcgatcgcagcctcgccaaggctcggcagcggctacaggtggagctgccggccatcctttgctgcaacgctttgacggaactttgacgagaattaggcgacacaatccggtaggctcaccactttcttgaaaggagcaactccccatggccaaagccactgcccgtcacatcctcgttgccagcgaagccaagtgcaacgaactgaaagccgaaatcgaagccggcgccgacttcgccgaagtcgccaagaagaactccacttgcccatccagccgtgacggcggcaacctcggctcgttcggcccaggccagatggtcaaggaattcgacaccgtggtgttcagcgccccggtcaatgtcgtgcaaggcccggtgaaaacccagttcggttatcacctgctggaagtgaccagccgccaggactgatcctgtcgcgatttgcgtaaacgacggcccgccctttggtgggccgttgtgtttgggctacggcccgcgctggtcagcagcgcgccggtagcgtacaaatcgtgatcatcgatcacccggctcttaaggctgacaatgcgactgcttttcccctccctgatcttcaccgccctggccctgttgctgggcaccgcgagtgccgacgccgcaccgcaacacgccttgaccgtctatggcgaaccggccaagtaccccgccggcttcagccacttcgcctacaccaacccacgggcgcccaagggcgggagcatgcgccgctcggccatcgagatcggccgcttcgaccatgtgttgccctacatcgacaaaggcatcggtgtctcgcaactcgacggctatatctactcgcccctggcccagcgttcgctggacgagccctacaccgtgtacggcctggtggcacaaaagatggagcgtgccgacgacggcctgtggctgcgtttctacctcaaccccaaggcgcgcttcgccgacggccagccaatcaccgccgaagacgtgcgctacacctacaacctgctgatgacccagggcagcctgcgttatcgcacccagttcgctgacgtgaaggacgtcgaagtcgagtcgccgcgggtgatccgcttcgacttcaagagcaacgaaaaccgcaccctgcccctggatatcgcgaccctgccggtactgcccgagcactggtggaagagtcgcgacttcgctggcggcggtggctacgaagcgcccctgggcagcggcccgtacaaggtgagcaaggtcgataacggcaacagcatcaccttcacccgcgatgccgactggtggggcaaggacctgccggtcagccgcggcctgtacaacttcgaccgcttcagcatcgagtacttcggcgacaccgacgtcgcccgccaggtactgcgcggcggcgcctacgattacaaccgcgagttctccgccaccggcttctccatcggttacgacagcccggccctgagcgacggccgcctgcaaaaggcccacctggccaaggaggcgccgcaaccggcccagggcttcgtgttcaacctgcaaaaaccgatgttccaggatcgccgcgtgcgccaggccctggccatgctctgggacttcgagtggagcaaccggcagatgatgcgcgacctgtacatccgccagcagagcttcttctccaacagcgccctggccgcgcgggcgctgccggatgccgaagaactgaagatcctcgaaccgctgcgcggccaggttcccgacgaagtcttcacccaggtcttcgaggcaccgaaaaccgacggcagcggcctgatccgcgataaacagctgcaagccctggccctgctcgaagcggccggctggaaacccgacggcgaccaactggtcaacgccgacggcgagccgctgcgcttcaccttcctcaacagccagaacggcatcgaacgcctgttgttgccctacaagcgcaacctggcgcagatcggcatcaccctggagatccgccgcatcgacgcctcgcagtacgtcaaccggctgatggcccgcgactacgacatgatcgtcaccggctatccggtgaccacttcgccaggactggagctgtacaactacttcggctcggcggcggccaacgaccccggttccagcaacctgatggtgctgaagaacccggcggtggacagcctgatcagcggcctggtcaaggccaccagccagccgcagatgctgcgctacgcccatgccctggaccgggtgctgcaatggaattactactggatccccaactactacccgccgggcacctccaccgtgtggtggaaccgcttcggcatgccggccattcccgccagcaatgacgaagccatcgaaagctggtgggaaatgagccgcacgcccctgaccaacgagcaaatggcggccgaacgcgtccagcgcggcaagcccggagggccacactgatgctggcgtatatcctgcggcgcctgctgctgatcatcccgaccctgctgatcatcctgctggtcaacttcgccatcgtccaggccgcccccggcggtccggtggaacaggccatcgcccgcctgcaaggcataggcagtggcggcaacctcggcggttcaagcgacggcatcagcggcaattcacgggccagccgtggcctcgacccgcagctgatcaaggacatcgagaagcagtacggcttcgacaagccggcccacgagcgcctgtggctgatgctcaagagctacgcgcagctggacttcggcaagagcttcttccgcggcgccacggtcaccgagctgatcctgcagaaaatgccggtgaccatttccctcgggctctgggcgacgctgatcacctacctggtgtcgatccccctggggatccgcaaggcggtgcaccacggcagccatttcgatatctggagcagcaccgcgatcatcatcggctacgccatgccggccttcctgttcgccatgttcctgatcgtgatgttcgccggcggcacctcgctgaactggttcccggtgcgcgggctggtctcggagaacttcgagcaactgagcaccctgggcaagatcgctgactacttctggcacctggtgctgccggtaacctccctggtgatcggcggtttcgccaccctgaccatcctcaccaagaactcgttcctcaacgagatcacccgccagtacgtggtcaccgcccgggccaagggcctgagcgagcgccgggtgctctacggccatgtgttccgcaacgccatgctgctggtggtctcgggcattccccaggcctttatcagcgtgttcttcgccggctccctgctgatcgaggtgatcttctccctcgacggcctcggccgcatgagctatgaggccgcggtgtcgcgggactatccggtggtgttcggctcgctgttcatcttcaccctgttcggcctgctgataaaactcatcggcgacctctgctacaccctggtcgacccgcgtatcgacttcgccgcgaggaacgcctgatgctcaagctctccccgctggcgcgccggcgcttcgagcgcttcaagaaaaaccgccgtggctggtggtcgctgtggctgtttatcggcctgttcatcctcaccctcggtggtgagctgatcgccaacgacaaaccgctggtggtcagctaccagggctcgctgtatttcccggtgttcaagcgctacaccgagcaggagttcggcgggcagctgccgttccaggccgactaccgcagcgactacgtgcagcagctgatccgccaggacggcggctggctgctgttcccgccgatcccgttcagcgaagacacgcccaactacgacctcagccgcccggccccaagcccgccgaccgcggtcaactggctgggcaccgacgaccaggcgcgggacgtgctggcccgggtgatctacggcgcccgggtgtcgatcctgttcgccctggccctgacctttatcagcgccctgatcggcatcgccgccggtgccctgcagggctattacggcggctgggtcgacctgctgggccagcgcctgctggaagtctggtcggggcttccggtgctgtacctgctgatcatcctttccggcttcgtcgagccgaacttctggtggctgctggggatcatggcgctgttctcctggctggccctggtggacgtggtgcgcgccgagttcctgcgcgggcgcaacctggaatacgtcaaggccgcccgcgccctgggcctcaacgaccgcaaggtgatcgtgcggcacatcctgcccaatgcgatgaacgccaccctgagctacctgccgttcattctcaccggggcgatttccaccctcaccgccctggacttcctcggcttcggcatgccggccggcagcgcctccctgggcgagttgatcggccagggcaagcagaacctgcaagccccctggctgggcctgacagcgtttttcaccctggcgctgatcctctcgctgctggtgtttatcggcgaggcgctgcgtgatgccttcgatccacgctcctgaatcaagcggactgttaaatgactgacaacctgatcgaaatccgcgacctcaatgtggccttcaacggtcagaaagtggtgcgcgacctgtgcctggatatccgccccggcgagtgcctggccctggtcggcgagtcgggtcgggcaagtcggtgaccgcccattcgatcctgcaactgctgcccgactgcgacacccagagcagcggcagcatccgctaccgtggccaggagttgctcggcgccgaagcacggaccttgcagaagctgcgcggcgaccgcatcgccatgatcttccaggagccgatgacctcgctgaacccgctgcacagcatcgaaaagcagatcggcgaaaccctgctgctgcacaagggcctgggcggcaaggcggcccaggcgcggatcctcgagctgctgcgcctggtgggcatccagaaacccgaggagcggctcaaggcctatccgcaccagctttccggcggccagcgccagcgggtgatgatcgccatggccctggcctgcgagccggaactgctgatcgccgacgaaccgaccaccgccctcgacgtgacggtgcagcgcaagatcctgttgctgctcaaatccctgcaacaacgcctgggcatgtcactgctgctgatcagccacgacctcaacctggtgcgtagcatcgcccagcgcgtctgtgtgatgaaggccgggcagattgtcgagcaggcgccgtgcgaaaccctgttcaccgcgccccagcacccctacagccgcgtgctgctcaatgccgagccggaaggcgaagccctgccccgggacgagcgcgaagtggtgttgcaggtggacgacctcaacgtgcagttccagatcggcggcgggctgttccgccgcaagcactacctgcgggcggtggacggtatcagcctgagcctgcaacggggcaagaccctgggcatcgtcggcgagtccggctccggcaagtcgaccctcggccaggcgatcctgcgcctgctggactccgaaggcagcatccgcttccagggcgaggccctcgacggcctcaaccagaagcagctgcggccgtggcgcaagcagatgcaggtggtgttccaggacccgttcggcagcctcagcccgcggatgtcggtggcgcagatcatcagcgaaggcctggaagtgcacagccagtccaccgcccagcagtgcgagcagcaggtgatccaggtgctggaagaagtcggcctggacccggccagccgccatcgctacccccacgagttttccggcggccagcgccagcgcatcgccattgcccgggccctggtactcaagccggcgctgattttgctggacgagccgacctcggccctcgaccgcacggtgcagaaacaggtggtggcgctgttgcgtcagctccaggaacgccacggcctgacctacctgtttatcagccacgacctggcggtggtgcgcgccctggcccacgacatgatcgtgatcaaggacggcaaggtggtcgaacgcggccccagccacgaagtgttcgacgcgccgcaacatccctacacccaggaactgctggccgccgcccacccggcctgaacccgcattcccctgtaggagcgagcttgctcgcgatgcaagcaccgcggtattgcaggcccaccgcgccgaacccaccgcaggcaagcctcactcctacagaagcaccactctgtagccgctggcgaagcctgcgatcgaccgcgaagcgggcgcagggtctggaggccgccggaggtccttcggacctttcgcagcctgcggtagcggctacagggatagcggcaaccctgatggtcgcgtcgccgtgaagattcccggcataatcggcgccgcgctcccttcaggacctccccccatgaacgacaccgaaagcctcaaggattaccagcgggtccgccaactggcgatccgttcgctgttcgagatcatcgagcaatccagcgagggcacggtgatcgtcgaccgcgacgccaatatcgtctggatgaacgagcgctacgcccggcgcttcggcctggagtcggcggcgttcgccatcggcaaggcctgcgaaagcgtgatccccggcagcctgttgcgcgaagtggtgcgcaccgggcggccgatcctgctggacatgcaggacacccccaaggatccgctggtggtgatgcgcctgccgatccacgacgacgccggagcggtgatcggcgccatcggctttgccctgttcgacgagctgcgcagcctgtcgccgatgctcaagcgctacctgagcatgcaggaagagcttgcttccacacgctcgctgctgcgggcgcggcaggccaaatacaacttcgcccacttcattggcaccagcgccgccagcctggaagtcaaacgccgggcgcggcgcagcgccagcgccgactcgccggtgctgctgcaaggcgagaccggcaccggcaaggagctgctggcccaggccatccacgccgcgtcgccgcgggcgcacaaggcctttgtcagcatcaacagcgcggcgattcccgaggccttgctggaggccgagttcttcggcaccgcccccgcgcctcaccggcgccgaccgcaagggccgcgccggcaagctgcagatcgcccagggcggcacgctgttcctcgacgagatcggcgacatgcccctgccgctgcaaagcaagctgctgcgggtgctgcaagagaaagagttcgagccggtgggctccaacgaggtgatccagagcgacgtgcgggtaatcgccgccacctccaccgacctggaagcggcgatcaagcgcggcgagttccgcgccgacctgtattaccgcctcaatgtgctgccgatccaggtgccgccgctgcgcgagcgcctggacgacctgccggccctcagcgaagccatcctcgaagaactgcgcagccagcacgaactgaccccgatgccctggccctgctcggccaacacgcctggcccggtaatatccgcgaactgcgcaacgtcctggaacgcgccgccctgctcagcgacgacctgatgctcaacgccggcgacctgcgcgcggccatcggcaccttcagcccggtgccgcgcgcggccagcccccaggctgccgaggtgcaagccaacgaaaccttcgccgccgcgcgggagcgtttcgaccgccaggtgatcgagtcggccctggcgcactgtggcggcaaggtggggcaagccgcggcgcgcctggggctggggcgctcgactttgtacaagaagatggcggcgctggggatcgaagagtctcaatagagagacataaatctctatacagagacagccttgagcgcttcgcgctcatcgcgagcaagctcgctcctacaagggtttgcagcgtacctgtaggagcgagcttgctcgcgatagaaatttcccggccaacatgtcccggatcagagacaaatatcctcaaagccttccaataaaaacaagaacacctttataaatcaaacagttatccatctggcacaaaactcgctatagcccctcccacacccgcaacaccctacaaaaataacaatcctggagagacacaccatgagtgtgatcattgccctagcagccctcgcgctgctgatgttggctgcttaccgtggctacagcgttatcctctttgcccccatcgccgccctcggcgccgtcctgctcaccgacccgtccgccgtggcgcccgccttcaccggcgtgttcatggagaagatggtcggctttatcaaactctacttcccggtgttcctgctcggcgcggtgttcggcaagctgatcgagctatcaggcttctcccgctccattgtcgcggcggccatccgcctgctcggcacccgccaggcgatgctggtgatcgtgctggtctgcgccctgctgacctacggcggcgtctcgctgttcgtggtggtgttcgcggtctacccgttcgccgcggagatgttccgccagagcaatatccccaagcgcctgatcccggcgaccatcgctctcggcgcgttctccttcaccatggacgccctgcccggcaccccgcagatccagaacatcatccccagcaccttcttcaacaccaccgcctgggccgcgccctggctgggggtgatcggcaccgtcttcgtgttctgcgccggcatgctgtttctccagcgccagcgcaacaaggcgcacaacgccggtgaaggctacggcagcgacctgcgcaacgagccggaaaccgccgccgacatccagctgcccaacccctggatcgccctgtcgccgctgttgctggtgggcctgatgaacctgctgttcacccactggattccccagtggtacggcaagacccacagcctggccctggccggcatggccgccccggtgcagaccgacgtcgccaagctcaccgccatctgggcggtccaggccgccttgctggtgggcatcatcatggtcctggtgttcggcttctcggccattcgcggcaggctggccgagggcagcaagagcgcggtcagcggcgccctgctggcggcgatgaacaccgcttcggaatacggcttcggcgcggtgatcgcctccctgccgggcttcctggtgctatcggactggctgaaaagcatccccaacccgctggtcaacgaggccatcaccgtgaccctgctggccggcatcaccggctccgcctcgggcggcatgagcatcgccctggcggccatgtcggagaccttcatcagcgccgcccacgccgccaacatcccgctggaagtgctgcaccgcgtggccgccatggccagcggcggcatggacaccctgccgcacaacggcgcggtgatcaccctgctggcggtcaccgggctgacccaccgccaagcctacaaggacattttctgcattacgctgatcaagaccctggccgtcttcgtcgtgatcgccactttctacgccaccggcattgtgtgaggtattcatgagcaatcttgcgggcaagaccgccctcgtcaccggctccaccagcggcattggcttaggcatcgccctgagcctggccaaggccggcgccaacctgatcctcaacggcttcggcgatgcctcgacggtactcgccgaggtcgcgcgcctcaacaaagacagcggcggcaaggtcggccatcacccggccgacgtcagcgacccggcgcagatcgccgacatgctcgcctacgccgagcgcgagttcggcggcgtcgacattctggtcaacaacgccggcatccagcatgtggcggcagtggaagaactcccggtggagcgctgggactcgatcatcgccatcaacctgtcgtcggtgttccacagcacccgcctgagcctgccgggcatgcgcgccaagggctgggggcggatcgtcaacatcgcctcggtgcatggccaggtcggctcggtgggcaaggccgcctatgtggcggccaagcacggggtgatcggcctgaccaaggtggtcggcctggagaccgccaccagcaacgtcacctgcaacgccatctgcccgggctgggtcctgaccccgctggtgcaaaaacagatcgacgaccgcatcgccgcgggggtcgacccgcaacaggcacagcacgacctgctggcggaaaaacagccgtccctggagttcgtcacgccttcgcagctgggcgagttggtcctattcttgtgcagtgaggccggcagccaggtgcgtggcgcggcgtggaatatcgacggcggctggctggcgcagtaagccgtcgtagccgctgccgcaggctgcgataagacccgaagggtctttcagcgccagtgatatcgccacgaccgttccggtcgatcgcagccttcggcagcggctacgggtagagttgcaacagctttgtgtgcattagaaaaacaagaggccacccatgtccgaattactctggcaacccagtgccgagcgcatcagcaagacccgcatggaagccttccggcgcttgatcaatcaccgtcacgacctggacctcgacggctaccccgccctgcaccaatggagcatcgagcggcgcgaggacttctggcaggccatcgtcgacttcttcgatgtcgagttccatgcgccccccaacgcggtgctgatcgaaggccgcaacatgcccgccgcccagtggttccccgacgccaccctgaacttcgccgaacacctgctcaagcggcgtgacgacggtgtcgcggtagtggcgatcaacgagaacggccagcgcgaacagctgacctacaaccagctggcggcccatgtcgccggcctgcaacagagcctgcgggccgccggcgtcggccttggcgaccgggtcgcggcctgcatgcccaacacctggcagaccctggtgggcatgctcgccaccgccagcctcggggccgtctggtccagctcctcgccggacttcggcacccagggggtgatcgaccgtttcggccagatcgaacccaaggtgctgatcacctgcgccggctaccgctacgccggcaaacagatcgaccagacggccaaggtcaacgagatcctcgaacgcctgccgtccctgcaacagctgatcatcgtgccttacgcgcggcccgaagcccgcgccgaagacttccgcacctcggccagcgtcgcgctgtgggacgatttctatcgccccggcggcgagccggcgttcgtcgccgtgcccttcgcccacccgctgtacatcctctattccagcggcaccaccggcgtgcccaagtgcatcatccacagcaccggcggcgtgctgttgcagcacctcaaggagcacggcctgcacaccgacctgcacgccggcgaagtgttgttctactacaccacctgcggctggatgatgtggaactggctggtctccgccctggcggtgggcgccacggtactgctgtacgacggctcgccgttccacccggcgcccgaacacttgatcgacctgatcgaccaggaaggcatcagcgtcttcggcaccagccccaagtacctggtggccctggaaaaggccggcatcgagccgcgccagagccattccctggccagcctcaagaccctgctcagcaccggctcgccgctgtcgccgcaaagcttcgactacgtgtaccgcgcgttcaaacaggacctgtgcctggcctccatgtccggcggcaccgatatcatttcctgcttcatcatcggcaacccgctgctgccggtgcaccgcggcgaaatgcagggcaagggcctgggcatggccgtcgaggtctggaacgaccagggccaggcagtgatcggcgaaaagggcgaactggtctgtacccggcatttcccggccatgcccatcggcctgtggcacgacccgcggcacgagaagctgcgcgcctcctacttcagccagttccccggggtctgggcccagggcgactacgccgagcaactggcccatggcagctggctgattcacggccgctcggacgccgtgctcaaccccggcggcgtgcgcatcggcaccgcggaaatctaccgccaggtggagaaactcgaacaggtcctggaaagcctggccatcggtcagcaatgggacaacgacgtgcgggtggtgctgttcgtgcgcctgcaggacggcgtgcaactggacgacgccctgcaggagcagatccgccaggtgatccgcgccaacaccacgccaaggcacgtgccggcgaagatcctcgcggtcagcgacatcccgcggaccatcagcggcaagatcgtcgaactggcggtgcgcaacgtggtgcacggcctgccggtgaaaaacaccgacgccctggccaaccccgaggcgctggagcagtttcgcgatcgccctgagctacgggactgacggccgcccctgtagccgctgccgcaggctgcgaacgacccgcaggggcgcgatctcaggaccgctgaaggccccgtgggcctttacgcagcctcgcaggctcggcagcggctacaagggctgggcgcggtgccagttgtagccgctgccgcaggctgcgcccggcaccgcaggggccgccaaaccgggcgacccgatccacctgccggatcggggaaaccgccctcgcaccggctacgccgtcgatcgcagcctgcggcagcggctacaatgccggcgtgatgtacgctcaggacacccccgacatgaacgcctccccctccggcagcgaagccgaaaccctgattgcccggctggactgggccgccacgccgctgggcgcggtcgaccactggccgcagagcctgcgcaccgcggtggacatcgtgattcactcgccgatgccgatgctgctgttgtggggcgcgcaactgacacagatctacaacgacggtttcgccctgctggccggcaacaagcaccctggcgccttcggccagtcgacccacctgacctggccggaactccaggacttcaccgcgccgatctaccaagccgtgctgcaaggccaggtgcgcaccttcagcgaaaaacccttcaccctgctgcgccacggccgtgaatcggacgtctggctggacctgacctacagcccgatccgcgacgaaagcggcgaagtcgccgggatcctggtcaccagcatcgaaaccaacgagcgccgacgcatcgccctggaactggagcagcgttcggcggccagcctcaaggcccagcacgaaaccgaagagcgcctgcaactggcgctggcagcgaccgatgcggtcggcacctgggactgggacatcggcgacgaccgctttatcgccgacgcccacttcgcccaactgcacagcatcgacccagcccaggccgggcaactgcccatcagcgactacctcaagggcgtgcacccggaagaccgcggcatggtggcgcgcagcatcaagcactgcatcacccacggcaccgaatacgccgaggaataccgcctgcaacagcccgacgggcagatccgctgggtcttcgcccgcgggcgctgctacaaggatcaccacggccggccggtgcgcttcctcggcgccgccctggacctgaccgaccgcaaacagatggaacaggcgctgcgccagagccagaccgagttgcaactgatcatcaacgccatgccggtgctgatcggctacgtcgaccacgaagagcgctttcgcctgaacaacagcgcctacctcgactggtacggcctgaccccgcaagagctgtacgggcggaccatccgcgaagtggtgggggacgagatctacgccacccgcgccgacaagatcgccgccgccctggccggcaaaccctgcagcttcgaagccaactcgccgcaccgcgacgggcgcgcgcggcatgcgctgatgaagtacctgccgcgctacggcgccgacggcgcgatcaatggtttctacatcttcgtgatcgacgaaaccgagcgcaaacagaccgaggaagccctgcgcaacctcaacgaaaccctggaagaacgagtggccgagcgcacccaggcgctggccgccgccaaccagcgcctgcagagcgagatgttcgaacgcgagcgcgccgaaaacgccctgcgccatgcgcagaagatggaagccgtgggccagctcaccggcggcatcgcccacgacttcaacaacatgctcaccggcatcatcggcagcctggagctgatgcagcgctacatcgacgccgaccgcagcgcggagatcggccgtttcaccgaagcggcgatgtcctcggccaagcgcgcggccgccctcacccaccgcctgctggcattctcccgacgccagtcgctggaccgccggccgctggaaccgaaccagctggtgcgttcgctgcaggacctgttcaaccacaccaagggcgaacatatcgagctgaagatgaacctgggcgccaacgtctggtcgatcaacagcgacgccagccagctggaaaacgccctgctcaacctggtgatcaacgcccgcgacgccatgcccgacggcggcgtgctgaccatcgagaccgccaacagctactcaacggcagcgacctgggcaccctggaaccggtcaaggccggcgactacgtgatgctcggcgtcagcgacaacggcgccggcatgaccccgcgagtgctggccaaggccttcgatccgttcttcaccaccaagcccatcggccagggcacgggcctggggctgtcgatgatctacggcttcgcccagcaatccggcggccacctggccatcagcagcgaaccgggccagcacctgcgtgcgcctgtacctgccgcgcctgtacagcgccgcccaacccgccagcccggcaccggccagcgtcgaagcgccgtacgcggtggccggcgaatcggtgatgctggtggaggacgacccggcggtgcgtatgctggtgctcaacgtgctgagcgaactgggctacagcgccttcgaggccgaggacgccaagagcgccttgcctttactggagtcagagcggcgcgtcgacctgctggtgaccgacgtcggcctgccgggtatgaacggccggcaactggcggagatcgcccgccagcagcgaccggaactcaaggtgctgttcatgaccggttacgcggaaacagccgccgagcgccagggctttctcgacgccggcatggacctgatcgccaagccgttttccatcgaggcgctggcccagaagattcgtcagatgatcggccggcagggctgatttcaggcataatccgcccccgccgtccgcaccgtttcaaggtaactgccccatgaaagcccaagcccgccacatcctggtgaaaaccgccgaagaggccgaacagctcaagcagcgcatcgccaagggcgaagccttcgacgtgctggcgaagaaatactccacctgcccctccggcaaacgcggcggcgacctgggtgaagtgcggccggggcagatggtcggggccatcgaccaggtgatcttcaaaaagcccctgcgcaccgtgcacggaccgatcaagagcaagttcggctatcacctggtgcaggtgttctaccgcgattgaccgcgtcgctcaccacgcttcgaccacgcccctgtagccgctgccgcaggctgcgatcggcaccgcaggggccgcaaaacctggcgacgcgacctatctgaagaatcggggataccgcccttgcgccggctgcgccgtcgatcgcagccttcggcagcggctacaggctggcgtcagggtcttgggatcaacgcccccggcacctggatcacccggctcgctaagcgatgcccggcctgcgccgcttgctgcggactgccgcctttcaagcgacacgccagatacgccgcactgaacgagtcccccgccgccgtggtgtccaccacctgctccacccgctgcgccggcacttcgaacgactcaccgccacagcggatcaggcacgcttcagcgccgcgcttgagcaccacttccggcgtgtccgcgtaggccgccaataccgcctggctgtcgacataaccgaacagcgcctgctcgtcatccaccgtcagcagcgccagatcgacataggccagcgcctcgcgataagccgcctgcgcctgctccaccgaagcccagagccgtggccggtagttgttgtcgaagacgatctgcgccccacgcttgcgtgcttcaaccaaggtctcgatcagcttcttgcgccccaactcgccgagcaccgccagggtgatgccgctgaaatacagcaccgcgtaggtcggcaacgccgcgaggatcggctcggccgcgggggtggtgaaacagtcgcgcaccgccgcttcgttgcgccagtaaagaaagcgccgctcgcccttggcgtcggtctggatgcagtacaacccgggcaaacgccccggcaggcgctggaccatgcccaggccgatgccttcctcggcccagctgtggcacattgcatcgctgaaactgtcgtcaccgagggcggtgacatagtcgacatgggcgccctcgcccagttcacgggccaggtacaccgcggtgttcaaggtgtcgccgccgaagctctgttgcaggctgccgtcggcgcggtgttgcagttcgatcatgcattcgccgatcagggcgatgcgtttcccagtgctggaagtgttcatggtggaggcgtctctgacagttttttgttgttggggagaacgtcatcgtgggcaagtcggatcgtcgaccggccgctcctacaagggcaatgcggtcctttgtaggagcatccggtcgacgctcgattgctcgcgatagccgcaacgcggcgatggtcgccttagaaacaggtctccatgctctccagcacatccagccgctcatccaccagcaacccggtgcgccacttatcaaaggtcaaacacgggtgcgaagtaccgaaggcaataatgtcccccacccgcaactcaacccccggcgccacggtcatgaacgcatgctggtccatcaccgccgtgaccttgcaggcgctgacatcatcgcccctggccggcagcacgcccggcttgtagcgcaacaacggcaccggcagaccggcgtcataagccacgtcgcgcttgcccagggcgatcaccgcgaaccccggctccggcagggactgcacatgggcccagacctccagcgccgggcgcaggccttcgtgcaggtcgctgcgccggtcgagcacgcagcactgcgcttctttatagatgccatggtcgtgggccacgtaactgccggggcgcagcacgctgaggaaccgcccctgagcgttctgcgcctcgaaggactcggcgatcaggtcataccaggccgaccccgacgcggtgatgatcggcttatcgatagcgaacagcccgtcgtcctgcaactgcaccgccaggcgcaccagggacgcggcaaactcccgaatgccactgaccgcgtgatcgccatggattaccccttcgtagccctcgataccgcacaaggccagggccggttgcgccttgatcgcctgcgccagcgccaccacttcctgttcgctgcggcagccacaacggccgccgactacgccgtactcgatcatcacgttcaggcgcaccccacgcgcggcgaagaactgcccgaggtcggcgacgttgtccgggtgatcgaccatgcaatagaagtcgaacgtcgggtcggccagcagctcggcgatcagccccatgttcggcgtgcccaccagctggttggccatcaacacccggcgcacgccgtgggcgtaggccgcgcgggtctgcaccgcggtggccagggtgatgccccaggcgcccgcctccagctgccggcggaacagcgccggggtcatgctggtcttgccgtggggcgccagctcggcgccgctgtcgctgacgaacttctgcatccagcggatgttgtgttccagcgccgcgcggtgcagcaccagggccggcaggctgacatcgcgcaccaggctgacgcccggttgggcggcgcccttttccaccgcggcattgatcaaggcagaagacatattcgaactccttacggtgcagccacaggggctggcattagtcgttgatgcgacgggccaggcgattcgcgctgtcgatcagcacccggcggtagtcggcgtaattgttctgggcatcggcccgtggcgcgacgatgcacagggtgcagatgcacaccccgcgctcgtcccgcaccggggcggcgaagcaatgggtaaaggtgtcggccacgctgtcgaaggaaaagaaaccgtcctgcgtggcctggcggatctccttcaagaaggtcgccacaggcaggcgctccccgtcagggagcatgaagtcgcgctcgtcgatcaactcgacgatctgctcatcgctcaaatgccccagcaacaagcgcccggaagcggtccagggaatcggcgcgttctcgccgatattcgaggagatgcggaaatgccgttcgccctccttcatcagcgccaccgtgtatttgcgcccgttgagcaggcacatctgcgcggtctcgcgggtctggctgacgatctcctgcaaggccgagtcggcctcgcgggtcaggtcgaaatggcgcagatgggcctgccccaggaagtacagctgccggcccaggtacacatgcccgtcctggcccaccggctccagaacccgccgctccagcaaggacgccaccagctcgtacaccgtggacttggggctgccgatccccttggcgatatcgttgggccgtagcggctggccgatctccttgaggaaatcgagaatatcgaacgcccggtccaaccccttggcccgacgcttgatggtgtcttcggtcatctttgtgccttttgcaaaaaactgcgaaatttccggcgccccaaaaccccggcattgcccctatccccgtagcctcgccaaagctcggcagcggctacaacaaaccccacccgcccctgtaggagcgagcttgctcgcgatcagcggcctacagccctacttcttcttgtaagccacgcaatcgatctcaaccttgcaatccaccatcatgctggcctgcacacaggcccgcgccggcgcatgctccggcttgaaatactcaccgaacaccttgttgaaactccagaaatcccgcggatcctccagccacaccccgacccgcaccacatcctccaggccataccccgcctcctccagaatcgccaccacattgcgcattgtctgatgcgtctgctcaacgatcccgccatgaataatttcaccatccaacgccggcacctgaccggacacatacaaccagccatcggcctcaacggcacgagcgaaaggacgaggctggccaccgccggcggtgctgccggtgccgtagcgagtgatgctcatggggtgtttctcctaagtaaagggaaggttgagcagaataagccgttcctaaaaggcgcttcgcgtaactccaggagacatttattccgctatagcggatcaaaatatacaacaacggaaaattcacgaagagtgtgccatgggaaagagagggataacagaggacaggcaacacatctgggaccaaggagatagagaacaggcctgaaataaatgctgctaccccctatttattcagccattaatgacggctcgtgtaaggcgtttctgtatctggtgtaaacatgccctccaggcttgttactccgctatacgcctcctatattccgtttcgtcgctcccaacgctgcgaccggatttggccgtccgaatctccatgagcacaccctaaacttccttcatggagcgtcaccgtcatggattttcaccccctcacctcttccaacaccaccgaccaccccgtcgcctttatcaacccgcaagcccccttgcttgacctgctgacctacgccggcctgcgcatccgcgctgcccgcgacatgctggacagtgtgtccggcatgactagccgcaacgccgacgacctcgacctgatgcgcttctccagcgtggcaaccttgttgttgcaggacggatgcgacgtgttgcacgtggttgaacaacgggcgatggatctgccaaacccttaaccgaaccgccttagcctttgctcttgctgtgctttggctttggctttggctttggctttggctttggctttggctttggctttggctttgtttttgatccacccgccccatcgggaggccgagtggaggttctgcgcagtgggcaactcggcagggatgccgagttagccgccccaggccatggatggcctgtggcggcggcccacggagcaggaccggagcgagggaacctgagcgcagcgaaggccgtacgcaggggcatgaacgggacaaccacataggtaacagaaaagttcaggcacataggtaacaccaaatcaggcctatgacgccggactgagcctgatgtaaccgtcctgggcatctttcaaatcaaagcgacccaacttgatcgggccaaatatgacgtcccaaataccctcactgatacgctccagacctaccgtttcgcgcttgagcacattgccgacatagatcctgagccgacctctgttgacgatcccacaagagtcaacgacataggtttctatatggctgggatacctcatcactggtagccgtgccggataagttcgatccgaacagcaataacaggaggccggtgttctctgcccaagcgcctcatgcggtcgttcatgattgtagtgctgctggaacagatcaaagtgcttttgctgagcgccccattcaatttccggaggactgaccagcgtgcttttcagcgtgcggtgcatgcgttcatgacgaccattttgctcgggtcgacccggttggattcgctcgggaatgatgcccagacgtagccaccaaattgacaacagcgacaaccccgcacgccccgcactggcgaaaggaacaccattgtcagtgcgaatgcgttcgggcatcccataggttttgaacaaccgttcgaacgttttttgggcgtctttgaagttggtgctgggcatgctctcgcaggccaacagaaaacggctcgcatggtccatgaccgtcaaggggtaacaccagacgccttctcctgtcaggtattgccctttgtagtcagcgctccatagctgattggggaggtccgctctcttcaacggaattgggtagattgcaacacgctgacgcaggcgtcttggcgttatcaaaccagcccgcttgaggatgttgtagatgctggttttagagggcggctcctgccctggaaaacgctcagccaaagccacctggatcttcttggggcccggtgtcgtaggtcctttggagcgcaactcgatgatcgaggctttgatttcaaagggaatgatatgtgcctgagcatgccgactgcgactgcgctcatccaagccctgcacaccctctgcgttgtaacgggctacccatttgtagcccgtttttcgactgatgctgtgtgccgcacacagttcgcggaagttaaagcgtctcgacagatagtcggcaatgaacatcactttaaggtccatagggttcagctctcgccacggcatggtcagctcctcggaatcgaccctgccagttaaaaactgttacctatgtgcttgaacttttctgttacctatgtgggtgagtcataccggcaagcgtttttgcttacttttttggcgtctgaaaaaagtgagtcgccgtaagggcgaaaccataagccgccgtgaccgcagaaatggatatgtaccccatccaacatcaccagcgaagccaccaccgccatcgcggacaagcctcgctcctacagaagcttgtaaaaagtgccccaccgtaagggcgacaccataagccgccgtgaccgcagcaatggatatgtcgtgatttgatctttgtctgggcgaccaagctgctgtgttgcaggcggtaggactcgttgcccgtttcgacgatgtggcagtggtgtgccagccgatccagcaacgccgtggtcatcttgttaaggctgcacgcctaatgtgaacccacctgcggccgatagtctggaaggttcaccagtatcgacgtcttatttcagggtgatcaatggaaattccatacagcgtcaggctttcattttttgatttctggaagggactcttcaaaggcacgcttttcatccagaagcgtttgcgagggcatttgaaggagcagcagaagaactggccaaagaagcaacaatacagccaaggatatttctatcagggcttggaagaactgggcatcacaggcgtgaagcctacgggctttcggttcaagcaatacgccatcgatgaagcattgaagggcgctgacgtactggacatcggcagcaactgcggttttgtctcagtctattgttcgcgactggcgaaatccgtgacagccgtcgaactcaacccttttctcaataaagtggcgaaggatgccgcgcgttatttgaagcgcggcaatatagagtttatagaaagcgatttttcggtatttgccacagataaaaaatttgatgtggtgctgtcgttttccaatcatcacaccattgatggcaacctcaatatggggtttgaaaactacatgaagcgcctggtgtcgtttctaaagccaggtggctacctactgtttgaaagccacaatgttttcgggccaggtgctggcaacgtaggtgatgacggtgatatggacgaaaaaatcaaaataatgaatacctatttcgccatagaacgctatcgaatggtcaactgttacctgcgacacatggtcgatgatgtcgataagctcttcattgttgcgcggcttgtggacaatcctccgaaaacggaattccgtcttgaacaagcaatccgtcgctatcattattgaccctgcgttcaatttttttggctacccatgacaccgtctaaaaacggcagcgccagcacggacgctatcgcgagcaagctcgctcctacaggtgtcatgcaaagaagcagtcgctaccgtagcgcccccatcgttcaagtcgtggatcaggcttggcgggcgcaagcccgatcgcagcctgcggcagcggctacagggtccttacccataggggtgaacccgtcaaagctactaccgcattcgtggattcagctctggcgagcgcaaatgtgtaaccgtgggtagtcgttcgcgcaggaacggataggtatacaagacaggattcatgaagtggcatcaacgctatcgcgaacaaagcccgcacctgtcagtgacaaccaataaacagcgccagaccctctatcgcaggctcctccaacaaacgagcaataagccttacctggtttggcgtcagctccaactcacccaccaggccctcaagagaggaccaccccatgatctcaagcacggagggctccaactctttctggaccacttttttatattgcaacgaatcatcttcgtttggttctgggaaaaagcccgtaattcgcaggtacatgatgcggatgtccctctagttatttgatcgtcgttcttcctggctttgctggcttggtttgcttacccgtttcagcattgaactcccccaggtgcttaccttgcttgtcgtaaatctcgaccatgccatgttgatagtcccactcgtaaattcgtcccttggaatccttccaacgatcccgcttgcttccaccaccttggacgaacgacttcgggcgaacactcaccgcctctggaaatgccgggagaacatcgggcgccctatgatagccgaggcctcccggcacactgagcacaacgtacagcggctgaactccagcctctggcggaaagaccagaatgaaatcgttgtactcgggcggatacagaggattgacgatgatgttatctgcctgctcggtaggcggataaatccatatctgcggtgcctgtggggccccctccagtgggggaatgcccgtagtaccggacggatcaacggcaggagtccatatcaacgtgatgccgttaccgaagtctgccacctgatgggcgccctgcacctcgaattgcacgacgggaatcatttcccaatcacggcgcttctcagtgttgtatccgtaacctttcaatgagccatcggcttgctgctcaatatgcagccgaacccgagtgcgtccttgcttgagagatttgagttgttcgtcggtgtatagagagctatcacccaggcttgaaggccaaagcattgctatcacgccaagcaaggtgctcgacacgaccccggcgctcagcacaccaacttcttcgataactgttattgccttagcggcgccttccatgacagcagctccagtagcaactgcgcctgaagcgccagagctgcccaaagcaattgtccccattgctgcgggcaacgccctcccgccgatagtcccgagcttgatgtttcctgcaacatcaaactcacgccaacccaaaagtgtgagttggccatactccgctacggagtcagtggggatgaaagcgctggcgtaattgatgacgccatctggcagcttgcaaggcttggtaaacgtgcacccaaccggcttaggtttttcttctggcgttggtggaagctctttatattcggcccatcgttgagcaccaaggtctacaggttctattcctttgttacggtagccttttggctcattgggtacgtagccgctcatccatgcatgtccttttccgggctgacattgaccagacagcaccctactgaaggctgacgctccaggctttaaggccattctcaaaatgctgatccgtattcctcaggcaacttcaattcccgctcaccgttgaataacaagcgctaggtatcccccctccccactcattattgcaatccccacaacagctcattgcaaaagatagctagctaactatcaagatttcttattaccctccggtctccagccaaatgctgtccgcggggctctagcctgcctatccggacagcatcgattactgatgaggtcacccatggaaccaggcagttatcaattgagcatgagcgtgctcatgacgcccgacaaagccaatttctccggcaacgtgcacggcggcgctctgctgaagttgctcgacgaagtggcctttgcctgtgccaagcgctatgccgggcgctatgtggtcacgctgtcggtggatcaggtgatcttcaaggagccgatccatgtcggcgaactggtgaccttcctcgcctcggtcaattacaccgggcgcacctcgatggaggtcggcgtcaaggtgatgaccgagaacatccacgaacgcacggtgcgccacaccaacagttgctacttcaccatggtcgccgtcgaccccgacggacgcccgcacccggtgcgcgccttcgtgccggaaaccgccatcgaacaacgccgctacgcccagggtttgctgcgcaaacagcagcgccaggagctgcaggagcgctatcagcagatccgcaactcggattgagcccgccctgcccgcctgaacccatgtcttgcgatttgcccaaggaacgaccatgaagatatcgctgctcagtcgctacgcgaccctgatcctttgccttgcccttaccttgttcggcctgttgtattggcccgccagcccctggggccaggggctgatcgtgctggccggggtgctcagcctggtcggcctcaacgacctgctgcaaagccaccatgcggtgcgccgcaactacccgatcatcggcaatatccgttacctgatcgagtcgattcgcccggagatccgccagtacctgctggaaggcgacgacgagaagctgcccttctcccgctcgcagcgttcgatggtctacgcccgcgccaagaaccagcccgcggagaaggcctttggcaccctggccgacgtctatcagcccggcttcgaattcatcagccattccatggtcccgggcgatgcttgcgaccccagccagttccgcgtggtggtcggcgggccggattgcctgcagccctatagcgcctcggtgttcaacatctcggccatgagcttcggcgcgctgagcgccaacgccatccgcgccctgaacaaaggcgcccggctcggtggcttcgcccacgacaccggggaaggcagcatcagcccctatcatcaggaattcgccggcgacctgatctgggaaatcggcagcggctacttcggttgccgcaccctggacggtcgtttcgatgcccagcgcttctccgagcaggccagccatccgcaagtgaagatgatcgaaatcaagctcagccagggcgccaagcccggccatggcggcatcctgcccaagcacaaggtcaccgccgaaatcgccaagacccgtggcgtgcagatgggccatgactgcgtgtcgccggcgcggcactcggagttcagcacgcccatgcaactgctggagttcatcgtcaagctgcgcaacctgtccggcggcaagccggtgggcttcaagttctgcgtgggtcatccctgggagttcatggccatcgtcaaggccatgctcgagaccggcatccagccggactttatcgtggtcgacggcaaggaaggcggcaccggcgccgcgcctcgcgagttcaccgacaacatcggcatgcccatgcgcgagggcctgctgttcgtgcataacaccctggtcggcgccggcctgcgctcgcagatcaagctgggcgccagcggcaaggtgatcagtgccttcgacatcgccagcgtgctgaccatcggcgccgactgggtcaacgccgcgcgcggtttcatgttcgccatcggctgcatccagtcgcaaagctgccacaccaacaaatgtcccaccggtgtcgccacccaggacccgctgcgccagaaagcgctgcaggtcacggacaaggccgagcgggtgcacaacttccatcgcaacaccctggtcgccctcggcgagatgctcagcgccgctggcctcgaccacccggcgcagctgcaggccaagcacctggtgcggcgcctgaccaccaccgaggtccggctgttctcgcagatccacgtgttcctcgaacccggcgagctgttgcaacgccccatcagttcggagttctacgcacgcatgtggaacatggcccagccccacagctttgcgccgctggttgtggctacgcccgccaggattgagcggctgacaccggcttagaccgatgctggttgagtttctggatgtaacgcctgtgtaagagcgcaggcgttgcccggtggcccgggatgccgcaggtaaacgttatgccgctactgatcctggattggccgaaacgaaagatcaggcttgatagcagcgaagagtttgctcagcaactcatcgccggagcaggaatctgactgcagatagtctccatcagcccaatggctccacccggccttgagtagcaggctgtcacgctgaaaggacttaacgataccttcatcccaaccatcgaaagtctctccgcgccgatcgaaacccaacacatcctcaagataagcgccgacagcgcgccagagatcactgtcgtaagcatcgaactccagggtgagatgaccattggccattttgaaaagtctgggctgcatgagatatccccctggctgtatctaccggaaaaactccccaggcgtggcatcgaactgctggcggaacgcggcgataaaggccgaggtcgagtcgtagccgcaggccagtgccacgtccgtcacccgctcgccgttctccaggggcgtcagggcgcccagcaggcgcaggcgctggcgccaggcgcggaaggtcaggccggtgtcccgcaggaacagccggctgagggttttctccgtcacccccagtttctcgctccactgccccagggtggtcggctggtccgggtgcgcttggaggctgcggtagatctgtcgcaggcgcgggtcctggggcagcggcaacatcaggtccagttgcggcgcggcggccagttggtccagcaggacctgggccaggcgcccgtcggcgccgtcttcggcgtattccaccggcagctcgctgaaggcgcggatcaattcgcgcagcaggctgctcaccgccagcacctggcaggtttcgccggcccaggcagtgacacggcaatccaggtacaggctgcgcatttcagtgcgcggcgagctgaacaccttgtgcggcatgccagcgggaatccacaccgcccgttgcggcggggcgatgaaacgcccggcgctggtctgcacttccagcacgccctggatggcgtaggacaattgcacccaggggtggctgtggcgccgggtcagcgccctattgggcagggattcggtgcgcccgtacaccggtcgcggcaggctcggcagaccgggaatactgcggcggacgatcttttcatgtcctttaggcggcatttactggctcattggcgttagtcggcagtccgccatcacgttagagtcggcccaccgccctggcaacccctggatgatcccgttatgagtcgctcacgtcttttgcccgacaatttcaccctgaccctgatcggcgtggtgctgctggccagcttcctgcccgccagcggccaggtggcgctaggcttcggctggctgaccaacgccgccatcgccctgctgttcttcctccacggcgccaagctgtcgcgcgaggcgatcatcgccggggccggccactggcgcctgcacctgctgatcttcagcctgaccttcgtgctgttcccgatcctcgggctggcgctcaagccactgctgtcgccgctgatcggcaacgagctgtacctgggcatgctctacctctgcgccctgcccgccaccgtgcagtcggcgattgccttcacctcgctggcgcggggcaacgtgccggcggcgatctgcagcgccgcggcgtccagcctgttcgggattttcctcacaccgttgctggtgaccctgctgctgaatgtgcacggcgatgccggctcgaccctggatgccatcgtcaagatcagcgtgcaattgttgctgccctttatcgccgggcagatcgcccgccgctggatcggcgcctgggtcggccgcaacaagaactggctgaagttcgtcgaccagggctcgatcctgctggtggtctacggcgccttcagcgaagcggtgaacgaaggcatctggcatcagatcccgttgtggaacctggccgggctggtcttggcctgctgcgtgctgctggcgttggcgctgttggcttccagcctgctgagcaagctgttcggcttcaaccaggaagaccgcatcaccatcctgttctgcggctcgaagaaaagcctggccaccggcgtgcccatggcccaggtgctgttcgccggcagcaccatgggcgtgctgatcctgccgctgatgctgttccaccagatccagctgatggtctgcgcggtgctggcccagcgttacgccaaacgccccgagtcggtgccggagttgatggcgcaggtcgatccctgaagcacccgcaacagcccttgcaggagcaggggcttgtgcttttgtcgggacggcaagccaatggcatactgccatccctttgccgcccgacgaccctacatggaagtttttatgtgtttcccgctcgtgcctcacgctttgcccctcctcgctggttgccgcctcagacaagcgcccactcccgctgaactcagcgctgttcaggagtgaaaagcatgacgcttacagccgatcgggtactccagcactacctgcccttgaacccggtggaaaaaaaactgctggcttacggcgccacaggagcgcggttcagtatcgccaagcaaaggcctgtagccggcacggcggaaaacaccattcgcgccagtttcctgaggttcctgatactgggcggcgatgacaagaacccaatagatctgaacggggttcacctcgaaggcgccttcatccagggttccctgcacctcagctccgccaccatcgccactaacgtcagtttgacccattgcctgtgcgacaaggacctgcggcttgaaaacacggtgatcgacggctggcttgatttgagcggcagccagttttccggcgttgaggcccagtatcttcgcgtgcgctcatcgttcagcctgcgaaggttccactgccagggaaccctatgcctgataggcgcaaaggtcgcaggatcactgatattcagcggcgctcaactcgatggcctggggaaaaacgccctggatgctgatcgttgtgtcattgacgcaaacatcgtattcgaagacgggttcaagtcttcaggcgaagtacgattgaacagcgcgacgatgaaaggattgaagtgctcggattgcacttttaccgccactaccggcattgccttgaacgcggacaaggctcatgtgagcggtagcgtatttctgtctactggcttccactccattggcacggttcgcttcacagccgcgcgaatcgacggacagttgagtctgaaaggttcacatcatctggatggcaacggcggtttttccttgatcgcgcaaaacatgatcgtcggtaaaacactgatgctcacccatctggaacatcctttacaaaacgcggctttcagcggctctcacgtcaggaccttgagcgacgactcaaagacctggggcaaggagctgggccttaacgggtttacctacgacttcctgaccaccgactcccccttgagggccaaggatcgtatcgcctggctcgactcacagctgccatccagcaccggcgacgacggtctcaaaggctccgagagtggattcctgccacagccctggctccagctgaagcacgtctttgaaaagatgggccacttcgaagaggcacgcgaggtcggcattgctttcgaacagcgtctacgcaaggtcggcatggtgggccatcgcaccgccaactggatatggggaacccgctggctcggcaaggtcccccacgtgctctatggcgctctcaccggctacggctatcgccccatgcggctgctggcctggatactgggcatctggctgttgttcaccagcgtctactggtacgccgccgtcgaacacaaagtcttcgcccccagcaacccactggtgttccagaacgaggcctacgccagttgtaccccggaatatggcgaggtctggcaacgacagcaccctgacaccgaacgccctgccgatatcggcaactggtacacctgcaaggccttgcgcggtgagtacaccggtttcagccccggcgcgtattcgctggacatcctgctgtcgctggtcgatctgcagcaggagaaggactggggacctatcactccaacgcccttccccagctattgggatgaactcaagaatctcgaatggggccacggcatccgtctgctgatctggctggaaaccctgatcggctggggcatcagcctgttgctggtggcgatcgtctccggcctgactcggcgcaaggaataagcgtctatacctgcacgggcctcgaacggggcctgtgctggtggctgtggggcatcctggcctttatcagcatcgtcggcatcccttggggccgggcctgtttcgtgatcggggccttctcgttctttccgttcggcaaggaagcgatcagccggcgcgagctgaacaatatcggcaccagcggcctgggggtgatcggcaacgtgctgtggtttgtgttcggcgggatctggctggcgctggggcatgaatcgccccgggtttcgtggaggcctcaactcttgagaagatgaggccatgagaaagactacgacctattcccctgaagtccgtgaacgtgccgtgcgcatggttctggagcacctgaacgactacccgtccgagtgggcggccattgaggccattgccccgaagatcggctgtgcagcgcaaacgttgcatggctggattcgccgtcatccaaccgatgccggtcagcgtccggggccgaccaccgaagagcgcgagcgcatcaaggctctggagcgtgagaaccgcgaactgcgcaaagccaacgagatcctgcgtctggccagtgcgtattttgcccaggcggaactcgaccgccgtaccaagtcctgagggcctttgtcgaccagtaccgtgaccgtctcggggtcgagtcgatctgccgtgttttgcagatcgccccgtccggttaccgcaggcatgcggcccaacagcgagagggcattgggatcgccagatgcacggtggagcggctaatgcggcaggcgggattgcagggtataaggcgcggacaggttgtgcggacgacggtggccagcgacaaatcgctgtgtccactggatcgtgttcaacgccagttccatgccgaccgtccgaaccagctctgggtctcggactttacctatgtctcgacctggcaagggtggctgtacgtggcgttcgtgattgacgtctttgcgcggcgcatcgtcggctggcgagtcagtaccagcatgaagaccgacttcgtactggatgccctggagcaagccctgtatgcccgccagccacaccgtgccgatggactgattcatcacagcgaccgtggcagccagtacgtctctattcgctacaccgagcggctggcagaggcggcattgagccctcggttggcagcaagggtgacagctacgacaatgccttggccgaaaccatcaacgggctgtacaaggccgagctgatttaccgtcaatcatggaagagccgcgaagctgttgagatggcgactttgaaatgggtgcactggtacaaccaccaacgcctgctgagctcaatcggatatatcccgcccgcggaggctgaggcaaacttccaccagcaacaagcaggtcaggccatggcggcctgacttaaacgaaacggcctccacaaaagccggggcgattcacgatggtcattgattgtattgaaagtccccagcgtgaagacgccttgactcacctaactgatcacgccgctttgagcagtgcagcccaattgcaaacgtaaagacgaaagatctcaaatctttgggttttgatagtttttgatttttacatcgggaccgcccttgagatattagattctcaccattccgtttttttgcttttatgaattctttcagttattcacggcagtccgttaccccctgtttcatcatcagagtgcatctcattaaataaaatttcctgtgagcgcgacaatcatgaccctaaaagccttcgcctccttcctgagtgtcgcctgcgtagtgcctttgaccgcttacgacgcactaccccatctgctacccagtggggatcactcaaaggctctcagcatacttggcgatggcgccgtcctcgccgaatatacccatctggccaacggtaatagtcatgccttcaaatacaacgcgggcgtcggcatggtcgacctcggcacggtgggagggaaatattcgctcgcttacaggatctcggctgacggttcgagtgtggcagaccgcagtgatacccgcgcaccagagggacgccatgcctttgtggttcccccccagaaacccgtgattcctcccgtgacgccacccgtaacgcctccgtccaccgcacccgtgacgtcaccgtttgctcctttcgcgacacccatccctgtggtgttccctcagttggtgggcgtcggtaacgcgcacacctctctggcccaaagacgcccagcagacgcggtcgctgctcaacctgcacaacacctggctgtctgacgcattggacagtggccgtgatgtcttcgcccgcgtgctggggatgtggcgactgcagcgcccaggatgatccagcaggtcaaggccttagagtgctcagcaagcagcacaccaaaatgtcgcgtacggagctaactgataccgagtcagtggagacgaccgcttcataaagggccaggttaggcaaccggaagaggtctacggtctgccgctcaacatcctgcagataaaacctttcctggggctcaaatacacaatgagctatgacagtgtgcgcagcagggcgatcagtgcctacgccggcagtgagctcaggggttatctgaccccttttgtcccttgatgactcggctgggacttgggcaggatctgtcccgctccatcagtgactacgccagtcgggcggactatctgggcgacgctaaactcaaacctgccgatgagcagaaaacccgaggttttgcctcggtcgaggcgcaatacaacctcaactccgcgggggctggcacttgacctgcgcgcagcccagcaagcgctggagaagcctgctggctatggcgtgacgctctcttactccctgggtttttaaaggcagggttcccctcagcctgtcgctacaaggcggcaggttgaagggaagagaggcaggaagtcatgtttcggcgggtgacgagacccctcattggctgggagcttgctgaatacagaatacagtgggttcattccagccggcactgaaccagcctcctcatccagtctcgatcgccatgggtaggtcaagccgcctgcgcacgttgatatcgacgttgaacgggaggccaataatggatcgaggccccctcaccttcggccatcgcccaggtgcctgctcaatggcgccccctcataaacgcctcgtgcactgcggctgcaacggccgaagccgcgccgcggtctcaaggccaacgacgccctccctatagcgacttttttattgctggcgcactgttcaaccgagctcctgctatcctcatccgcgctcgaagatccgtccatcaaagcggctcatgacatccgacacaatgacatcaaagacggcatggaactgctcgtcggttggctcgatggggcactgcaccgagatgggggtccgtagatccgcgttgacttgcaacgcttcatcgtcataacgcatccggatgttgtagccgatatgatgtttaggaaggctgtttgggttgcgatcgatggtaaacctgagaacgaaacacaattcgagctggtcgttgccgcacaacaggttgggcgtgagttccttcaggtgatcgccttcccaggtccctagcgcaatgtagtcatgagtgatgccttcattgtccgtccagatgcacggttccaattcgagatagcggggaaaatcaaaggccattttccccgccagatattgcagttcctgccagtatttcgaacgctgctcacagtactttgaatagcgctccctgatctgatcgtacttggccactcgaaaagaatctccttcacttcacgttgaattgattattttatggggtcgctcgtctattcccatccaggaaagcatgtccgtatgtatcaggacgctgatgggctacgacttgagcattgacagtgtgataaagccgccaccccgtttagccacaggccctaggcaacgcctcgccgtgggcagtagaaagcaagccgctgggtataatgtatgcttggcaaaaaatgcctgttcaccacaatgaacgatccccaagactggacttgaccttgggatgttcctggcggcgagcggcatcgcgcctggtggtactgccaaagcgcgacaaccgagctgtcggcggcctcataccgataacgattcatcaggcttctcggggcacgcgcaagatctcctcggccgccgagatgccgcaatgcccaaacaaatcgttggtgaaaaacagtagccaaaaccatttgactcatgcgtagtcaggccaatgggtgcttgtgtattcggggacctgcgagagattgttcagagtttcgctgcaccctcaccagagtgaagttcccgtcggcaagccgcgagcatacgctcgcggccaccaagcctccttcacagaaaaaagtgatgaatcagccgctaatcaccacccctgtgttgctgtgaatttcgctcaccacctgttccagaatatggctactgacctgcaacccgctctccagctgtagatccacctttgccagaccgtcctgagaggttccgtccgccccacttacatattccagcggcgtgccatgaccgtcgccggcctggaaggtcgactgcgtcaggtcattcttcggcgcagcattgtcctgctggtcgatgtacagcaggtcgctcttaccgaagttggtcaggagaacattcagatcaccatcgatgctcacgccatcatcggacgttgtttggcccgaccccggagcggccccagacagatccttggccacgaaggcatagtccccattaccggcattgatgctaacctgcgtcccagtgaagcagccattgccagtcatgtcgacccaacgctggctggccgccagatcaccgctctcgtcgaacttctgggctagcctccctcccaggttggtgtccgtagagctgtatgcacctggggtgacggtggagaagtgcgcaccgttgaaggcatcactgccgccaccggcagcctggaacatccctgcgctggtttcaatgtggtagttattgctcaagtccagatcgaacgtcgggttgaggatgatgctctttccgtcggcgctcagagacacatcaccaccgctcaagtcggtgatgactccattcgctacgctgaacgtcaaggcctgactattgtcatgattctcaccgcgatagccgggatggcttgtgtcgttcgcgtcactgaccaccttgatggtccaggtgccgtccgccagatgccccgccaagctcgacttgagcacgatgtttgaacgtacgtcaaagttggtaacgcctgccacatcactactcagtactggattcaactccatactcgccgcgtgggtcagcttgtgaccgagcatggccgtggtgtccgcactgatcgtcggagcggctactctggtatcgtaggtgatgcttttccccgcgatctcatgttgttgcaagttccaagccgcatcgcttcctgcagcaaacatgctacggatgttcctctgtaactcgttgctcgagaggtatatggaccaatgaccagtactgtccacgtcagctactttaatgaacctgtcacccagctccgggtcaattataagaccaacatgaccattagcttctgcagtacccgtcacagtcacacctgcggctctctcactggcattgatcacatcatcgccggtgaccggatcgatagtagcgcttatttcagggcctatagtatcgacgatgagatcccgtgtggcagtagaattattgccagccttatccgtgaccactgcagtcaaggttgtcttgctgccgggcctggggatttcagcgggggtgaaattcgtcgcccagctgccatcactctgcacaagaacagtgtgcctcttcccccccagttgcacgtccactgaagcgcctgccttagcagtaccttgaacgatgaaccggtccctttcccagtcattaatatattggtcgttgtctcctaataaatacggactaggcgtcatcgatgtggcgcccacgtgcgtgatcaccggggctgccagtgcagtagtatccaccattacagtcttagtaactgacgcagagacgttcccggccacatcggtggtgaccacactgatgctgctgttgccgtctgccggaacttcagtattggcaaaagacgacgaccacttgccatcaataccggctgtcacggtatgcgcggcggcgccccacaccaccttcaccgagctgcccgcctcggcagtaccggtcacgctcaccccggccgctttttcggtggcattgacgatgttgtcagcggtgaccgcgttgatcaccggcgccgacacggccgtgtccacggtcacggcacgccttgtcgtcaatactttaccgtcagcgcttgcttcctgggcatacacagcaatggcatcagtcaagatctcgccgctgttgaaactcgtggaccaatgaccactactatccacctgagccagcgtgacgtgaccggggggagaaaatccaaacttcaaaatcaccaggctattaggatctccagttcccgtcacggcgacaccagcggctttctcactggcattgatcacatcgtcgccggcaatagtatcgatagtaaacccggtgattttggtgtcgacgatgacgacctgttgcgtagggacagaaacattacctgccttatccatggctaccgcgctcagagtggagtcgccgtccgcgggcacctcgtcggaaggaaaattcgccgaccactgaccatcgataccggcagtcacgctcttctcgaccgagccccataccactttcacggagctatccgcctcagcggtacccgtgacagccacgcccgccgacttctcggacgcattgacgcgattgtcggttgccacctgatcgatcaccggggcagtcactactgtatccacgagcacattgcgggtggtcggtgcggagacataaccggtcgaatcggcggcggtcacgctgagcacggtagtgctatcggcaggcacctctccactggcgaaggtcgccgaccatttgccgtcagcgtcggccgtcacgctcttgtgcaccccgtcccatttcaactcaagcttgctgttcgcctcggcgctgccactaaccagcacgccagcctgcttttcagacgaattaaccttgtcgtcgccgctcaccgcatcgatcaacggagccttaacgccccaacgggtgaaggtagtatctttccaatcatccgccgcagtgctggtggtcagcgcaccctgtgccttaagatccgccacactggccttcaggttctcggttagcgccagacgcacggtatcggtacgcaccgcaccgtcggcgaatacaagcaggtcaggggtggacgcaagctcgccattgccaacaatcccaatttccgtcttgccatccacggtgcgggtgaaggtgatagtgcctgccacgctgtccagcgacttggtatagtcctcccacttgccggtgaagaaaatctgatcttcaccgtccagcaactggcgggcatcaaccatcgcccccggggtgatgtacacctgatccacgcccgaggaacccgttaagacgtgaacaacaccaggcgtcggcaaagcgaagctcgccggagacgaagcgaggccgcgaacgctaccaccaggactctctggcagcagcggaccgggattggacgaggttacactaggattccaatcgtcggccgcattgcctgcggtcgatgcgcccactccaatgagatcgttgacgctggctgacaggccctggttgatcagtgctttgcgcgcggtgtcggtgcgcacgctaccatcggcgaacaccaagagatcctgctgcaaggtaagttggccattagcaactatcaccttctcgactttgccatcaaccgttcggctgaatgtaatagatcccccatcggcattgagcaccttggagtagtcggaccaacgtccgccaaacagtacggtgtcggtgccagcaagcagttgacgagcatcgagcgatacgcctggagctgcccatacagtgtttgacaacgcattaccgctgaccgcagcattgctgctgggactatagtcatattccacgccatcaagggtatatttcgccccaatgctacggaagtccagcacctcacgatcttgagtttgaagaatcagataacgcagtgtggctgtcatatttaaagcacccaatactattataaaaattgatcgaaacgatcaagatcggaaattatccttccatcagatctggcagacatatcaggcccaccacaaactttcatatctaacggcagttagcctggaagaatgagggatatccagaataatttcataaaaacaatcgccactacgtggcactattcgactcagagccaacaggccgagcatcaccacaaaaataatgagattaacgccccacagctctaactccgttagcctacggggagcgttgcgtcaaatgtgccagtacaacatctccagggccatctagagcaacccttgcggcgtaagcaccatgattcgatcaataagctccaggagaagcgacttaccagtcttgttgcaaaaccaatcgcttttccagacgctccatagccacccgcacggtgcacccactgaaccaaaagtcctggaatctgattgacagccgccagtacgcgctccgaagtaaatgagcaggcgataatcgcgtcactcgctgcattatcggagtgaagttctcatcgacaaaccgcgaacatatgctcgcggccgccaaacctctttcacagagaaaagtaatgaatcagccgctaatcaccacccccgtattgctgtagatatcgctcaccacctgctttcagcgccccccatgaatttaccaaacccagcgttcgataacggttgcatctgcgaactttccgatgtatgcgttacgaagagataaccgtgctttttggcgccaggcaccttacgtctgtgactgagtacatagctataaatctgatctgcaagttcaggtatcaacgggatgacccgttcccgcgtctttgcgactgactgatatgccctcgcatccccctttgagtctgggcgcctgcccacctttatcgtgttcattccaaagtcgatgtcttcaactttgagatttaacagctcgccacggcgtagcccggtgatacggagaatggagaacatcaacgcgttacgtacctggacggcatattctcgtaccgggttgttgtctgcccttggcctcaacgtaatttcgagtctatcaagaacccagtcattcagatatttgtcttctcgaccgaatcggccaaatactcaccatcgaatccaacattgaagccttgggcattgatcgatcgttcggcaaacaggccggtacgtccaaccatctccagccgtacgccgcaaatcggttgaatgccgtcaaacgcgcttgagctgcagcctggacagagagcttgtgcgggtagacatgacggaaggccgtccggtgattcgtcgttgctcagggtcaccccggcgagccgccgatcgccatgtcctcatgcttgtccggcgggccggataattcgatctcatcgactgcgtaacgaccgatacgagtcagtctggtttctgcataacccgggtagatcttgatactgaccctgtgtgtgcgggcagcaccactgcactgtcacgaccatcggtacgcagctcgaactcgtcctattccatcgctggcttgtcggtgttttttttcagctgtaacaatcggtcattgatgcgcgatgtcagcgtcgtcggcgaccacacgacaggagggagtgatggctaaaaagaacccgcacagggcgagtttgaaagtctcgcaggccggtacagcctcctgagagtagccgatcagcgtcacagtgcaatgctctcctcaatggggccaaacagatccggcagcttgattacgatgctgcacctactggcgtcgcgctgacttggcgcaaacagttcgttaaccaagttgcgccaccgaagccgctcgacgtccagagttcggcgcctgaggcggtggatgtaataacaatggaacaacgtcatcgactgcgccaagcccatcgactggcgcttgaacgctcaacggatcaatcagcacgcgctctttcgacataaagaaggcggtggtttttaatgatttctcccgctcaaggcgcgcactttgagcttccagtccctggcgcttcagctgcttagtgtcagcagcttgctgtgcgcattcagacggcgcactcctgttgacgttgttagtcccacgacgcaatgcggactcgtccctgcacgagcggcaggtttcgatatgactagagccccgtcaagcaagatgccttcgatttcgcgtttgaacacagcgcaaagcaaacgacgttgcctggtcatcaggcacctcaatctcgcgaacactctcgcctaaatggatgttcagctttattgggccccgcccctccagacttggtaccggacgcctgccgctcgttttgtggaccgctcaggcgtcaattgggacgcttgacagaaccacgacaagacaccgctcctctgtttttttcagcattcccctacagccaacctcatttcttcggtgctcaatacaataagctctggagtctgttgtatggcttatctactgtccgatgctcaaaaaactcatcgctatccggccaacacgctcccgtgcgggtcaggtggtcaggcatttgggctttgcgcggccaagcggctgtccatttcagcacaaacagtctgctcgtttggcgggggcgatggggtgctcattgttctgaccaagcgagcgcaacgatcccaccactggctcaaacggcagcaacccctcacgccccttcagatgatgcaacacaacgcctggtcgtacaggcaactgacatcgagcgtcatcgctcctccagaacgaacgcccaccttgggcgcaggcgttcgtcttctggattcgccgtgtgcgctgtcgacagcagatgtccttcgcccgttcgtgggtcaggagtcgggccgtcgcgcgccttttgctgcacgctttctcttcgcctccccagtggcaggcgaccagcgcaacgatgtgtttacatgatcctcaaagcgcatttctggcgacggcgactaagctgggtggctgcctgtctgctgttcctgctgatgacggcgtggatgatcgccgacgagctgacggtcaatcaggcctgcgctcgcctgaatgccgccatcctccagagccgtcttcacaccgcgcagatcgatgcccaggtgaaccacactttggagttgttgaacaccttcaggttgagccagcagcagtgcacggcaccgttgtacaaggcgttgtcgaacgtggtcaggacatctgagtatgtgtatgacgccgctctgcagatgccggatggtaccctctgctcctcttatggctaccccttgccaaaagcgctgatgcctcaggctgaactcgatacgcattatcctgactcggttcgtgattactggtttccccgccagggcgacgcccaccaggccttcatggtgatcactcagcagcaggcatatgtctgggtcaacgaggagatcttctttgatgccctgccccccccctcttccatgacgttgcagtttatcgatgcacacgatgcgcatcctgtactggtcaaaaatgccgtggccccggccatcaagccgtccctgaaggtgggcgagctggcggtcgctgacggctattggagcctgaccttcaccacgccatggcccaacctgctcggtgtggtcagcctgtctggcgctgacgttcagcgggcctggtgggaacattttctgctcgccctgctcggttgcgccccagcgaccctcgttatgttgtatgtcggggggacgatttaccgacgttatttttcattttccagcaagatcacccgcgcggtacgccgcaatcaaatgaccctgcgctatcagccgattgtggatctgcgcacgggaaaatggtgtggggccgaagccctgctgcgctggaacgtgggggaaaagatcatcagccctgctcttattgtggccgaagtggagcgctgcggcgcgatccgcgaattgacccgatgggtgtgtcgtcgggtggccgaagactatgtcgctttcttccagcacgcaggcggacactacttcaccatcaacctgtccgccgaggatctggcagacctgcagttcgttgactttgtcagcacgttgttcacccagtacaaggtgcccgccgcctttatcgtgttcgaactgaccgaaagtgtcctggtggataaagagctggcacagtcgcaattgcagcgcctgcgcgatctcgggcaccgcatcgcgcttgacgactttggcaccggttattccaacctggcgtatctggactatctgccgatcgacattctcaagatcgatcgctcgtttatcacctccagtcgatatcgcgagcctgatgccatgtggcgccaggtgctggggatcgccaagatcctgcgtttgagtgtcgtcgccgaaggcgtggagtctgccgaacaagccgagctgttaacccaggccggcgttcctctggcacagggctggttgtattccaaagccctgtcagcgcagcagtttgtccagttgagcattgagaccagtgatctcacgtctgcctgatggcgctgacactcaacggggcgtgtccttctgtgggcgcggtacggtactctgagggcttttattacacggactgcattgttcctgtgagagaggcgctttgaaatctgatttagctgacggcgacacaccctgcgcaaacgcgtcagccgccacccccgatcctgttccgaaggcgctgatcacagcgattgatgaggtgtacacgcgggcgggtctgcaattgaccagtccggcccgtcgtgagcctgagagtgccgagtatggcgccactcgcctggcgcttgacggacacaccgttgcctttcgtgtcgcgaaaacaacgccgacgaagatgggacagttcgtcaccctgtggaagcgcccgctgccaggcgggcccattgccccgctggacttccatgataacatcagctttgtggtggtgagcgtatccgacgcccctcatcacggacagtttgttttcgaccgcaaaatactggcagccaaaggcatcatggccatcaacggcgcaggcggtaagcgcgctttccgcgtttacccgccctgggtcaagcctgtcgccaaagacgccgtcagaacgcagcaatggcaacggcggtacttcctcgcgcttgaacccgacgccagtgccgattgcgtgcaggtgcgccggttatttgctgtttagctcgaggtacaggttatccaggggcatgcgctagcatgccccgtcattgcaggcgcaaacccacacgcaccgaggtcgaccggcaaggcaaatattcgcgagccttgctcggcaaacctggtcacgcgcagcgccgctcaaatgttgcccagcgtctgaaccagcgtgatattttcaaaggggacacttttcgccaaatactctttctggatcaggcttctgctcaccaccccctgactggccctgtcgaacgccaagcgttttgccgggttgatgaatttcaccccggtggagctcacctggtagacatacgcctgtgtcgctgcgctggaggcaatgcgctgtttggcaaagtccaccgcgatgtttcttgaagccgagaacgaactgtaagcgctcttctcaataacagatccgctataacccgcattcgcccccgaaaggtgtgtgcttatagatgtattgctgccgagccctttaaagccaccggcgcgctcgatctcgctgagctgacgcagatccccccgaaaaagcctggaaggattgcggctgaacatgtagcccgtacgggaggcataggtgacgccactggaggccagggcggccatcaggctgccgacgcccaatccaaaagacgcccagcccaaggcggacgccgtcgcgggatcggactcctccagcaccgccgaggcaatgccggtagaagccgacgcggcgccgagtacggcactggcaaccccgatccctcctgccagcacggcgcccgagccaagcaaggccaggcttgaacccagcgtcacccccggacagcagaataccggccacacccaagccgatccccacaccggcttgccaactgatatggcccgtggggtcagcgtagttgaccggatccagctggcagtactggtatcgattgacacccgccgcgccgaacgggctcagactgtcagtcgaatagaaggtgcgcagtaccggactgtaggcacgatagccattgcccagcagataggtgttggaaacagcgtcatgaatctggccattgaacccacggctgttgctgtggatcagcgaggccgaagatgtggatgtacgcgtaataatcgtcatgtgaaattgacctgttgtgtgggacggcaggtgtcctgcatacctgccgtatcaaatgattgaatatgccgggaccatgggcattaccaggctcagcgctcatcaataccgaatgctcgtgaaacgctggcaagacggttcgcgcagaacccgacggagcctgtacgcagcacacgtcagcgagcgcgcacagcgaggccttcgcgccatagcggcccagcacgatggggttgaacgacgaagttaaaagccctgatgtgaccgttggcctcatcgacctgggtatcgctgcgtcaataacgacagggtctcgccgctaacgcagtgaccttaatccgatgtaggaaaggattcggggctggttgggcggataggacaaccctcagggaatgccaaacgcccgaataggggttctggccaatgcccctcctgctccgatcatgccaatgcctgccagcgtgaaggccagcccgctgtatttcagggccaggctatccgtggcaaccccggcgaagatcaggcctgaaccggtcagggtcgtgagggcgccgacaccttgcagcagcgtcgccgtgccgcccccaaagccggtgcccagcgcaaacgaggccgaacccagtccataggtgatccatcccagtttttcggcgtactcgtcgtcgccctgctgttcataaacgctcgaggcgattcccgtcccgatcgcgctcaaccccaagccgacagccgcgcccccgaaagccagggcaaccagggacaagctgccgccactggtgagaatagccagtgcgatcccggtgattgtaccgatcacgctcagggtgatgccgcccgtcacggtccaactgatgtggccggagggagcgataaaattgaccggatccagttggcaatactggtaccggttgatgccggcaacgccgaacgggctcaaactgtcgcgcgaataaaacgtacgcaacgctgggctgtaggctcggtaaccattgcccaacagataggcattggaaaccgcctcatggatctggccattgaagccccgggcattgctgtcgatcaggcgcgtcgaaggcgtcgatagactctagatggtagtcatgttgatttacctgcttgtctgcacggcaagcgcgcaaacacttgccgtatcacgttctgaatgatctggcgttaccactcccggcgctcaccaaaatccaagtagtcgtggtaaacggtgggcaacgattgcccgccaggcagacaggtggtgacgctgcgcacggtgcctgaggcatcggtgccaaaaagttcaagcgcgacctgacccccttgctggacataacgccccagcacaatgccacccaccgacaggtagagggttttggtatcgccgctgatttccccgatgacgctgtcgttgtcgtagatgtaggtcacctggtcgtcgccattgatgatttggctcaggttgccgagtggttcatatcgatatgcacaagcctttccagtgtcgggcacctgacagctgaccaggctgttggcggcgttgtagctcaggcggcgagcatgggggctactctcaggcccgttcaccaggttacctgccgcatcactgagcagttgtcgggtgatttcgcccgtgcgaagcgcgctgacgcaatcagactgataggtgtaatgttgtgtgtcctgtcccgtggtctcgatgctactgaagcgttgtccgcctgcgaagttataacgggtctcctgaggggaagcactgccttgggtgcgtgtggatgtgcgcaaatgaccgtaggcgccgaggtaggtataggcgtagtcaagattgtctgtcgcgctcgcccctttgctcaggctgcgagaggtcatcagtccgttggccgcacgcacacaggccgtatcgagcacggttttcatcgagccgttcgtgtagatgtccagtatgcggcgggactcgatgttgcatgaatcgtattcgaagtccatgacagccagatagcgctcgccactcaggaaagtgctgcattcaagggtgattcgcgccaatgccccggtggtgaaataggaagcggccagcttgatgcccagtccttgataatcctttcgccacaaacggcccaggtcgtcataaccataacgctgctcgagggcgagcggattcgtcgctttcaggatccgctgtctactcagcgaataggtcttttcggtcgtgaccgaggctccggaggcataggtgcgccgggttttggtcaacagcccctgggcgttgtaggtgtactgaaagtccgatgtttccaccccagcgtaggaagccttggcttgcgagagcaacccggtgggtttgtcgtagctgtagttcagcagggtgtcaggagtttcgctgagcgtcgtacggaccgaacgggtcaacaaggtgatcggttcgaatgtcgtcacggtgttggccgcattggcactgtcctgacaacgtgacggctggtcgtaataggcttgctcgtagctgaacgtctggctgccctgctcgacaagacgcccgaagccatcgtagcgtcgcgaggcggtcagaacggtatcctgctggttgccgagcttggatttgctgctgaccgacaccaccaggtgcatgttttgcagttcggcatcgtaggtgtaggtcgtgatgtctactcgccccttgccatcgctgtcatgcaccgcttcttccagcagtcggtcaaagttgtcataggaataagtggtacgtccgcctgtgcgattggcgctgatgaccttgcgaccaaaactgtcgtaagtgaccagttccaggtaggtcgtgaccttgccatcttccccgtttgtaatcgaggccagcgacaccgcccgtccggcatcgtcatagctcacccgatagtgcgagccgcacagtccgcgatgatcttcggtattgagcaccttgttccggctgatgctagcttccatcccgtcagcgtagcggattcgggtcagctccctggccgtataggtgtaccgcgtggtgatgttgctgacaatctcacgacccaagggcgtctgtaccttgtcgtactccgtttgcccggtcatcatgccgttgcccgaatactgcagacgcttgacacaaaacgcttcgccgttgggagcggcttccaacgtataggtgtgctgattattgaagttcgtatagtgggtgaactgctggcccgtggctgtcgtcgtgacggtgacgttctgatagccatacgtgggattgatgtatttgtagtacgcgtaactgtactgctcttgctgctgccaggccgtgccggcaaacagggttttcttgatcaaacggttttctgcatcgtactggtactgggtgatggcccccttgaaatcctgctcttcatgcgtcaggccggtgcacaggctgaaggttctttgcgtgaacttctccagcgtcgagccctcggcatcggttgagcggtgggtggcgatgaccttggcgtgattcttcactctgctatagctgtaggtgatgatatagggcttgttgggagaggggattgtctcccactgcgccatgccgacaaacgcgcgggcactggcggcggtgtcctctgtagccgaaatgtagtcggcagtggacataatcacgccgttcactttcgactctatgacacgaaccatatagggccgcacggtcacagggcccactgtcgagaccggcgagcggtaggagaagccgtcaaccttcttgtatttgaattcctgcgtcttcagggagtctgtagacccctgcggcttgaactgcgagcacttcagatggcagacgtaataaccctccgggcccggcggacagccttgctcctgcgtcgaatcggccgggtagtaggtgttggtcgtcgtcaggccggtttcgtcccggtgtgacagcagattgccaaatgtgtcgaaactgcgggtctcgtaaacctcacgactttctcctgcagcattggcgtactttgtggtcttcttggtccacaacgcaaactgctcaggctgccctgtaatatcctgactcgctaccgtcgggtaggtgtaggacgtcaaggattgtcggacacccgtctgggtatcgagcagatcctcttcgatgagcaagtgaaaacggttgaaggtgcgcttgattttgatgtcattgtgaacttccgtgacgctataggtgaattcatcggtgcgatagagggcattgtcgcgaccgagcacctggcgtctgcccagcgggtaacccgtgaagttattattactgtattcataggtcacgatgttaagttcggttttcgcagggttgtcgcccatggttttaagcgtcgaaacaacattcacggcccgggtgctgttgtagttgatggcgctgtaaatgaactcctgcaccttacctgtaggagatttgatgcgcgacaggtacacctgcccatctttggacgtgtagtcgaagtagaaacgctgctcgacattattgggcagcgagatgctcttgacgatgtcctggttgatattgcgctgaatgtagactttggtgacgctgcgttcgcccgccacgtcttgggtaacggtcactacccgttcagtcgaacccgggagcgccacgccgtaatcgatcgacagttgattaccctggccgtcatgaacgcgcgacagctcgtgatagagctcgcccggctcgctctcataggtaaagtgcaagcgctggccactggccgataccagctgagtgatgatacccaggtcgttgtagtattcggccgtgccgtttttgtgcgtgatgatggtgttgcgataggaaaccgggccctcaatgatacgtttggactcaatacggatatctttgagacgacgatactccagcatgaagtttcgggtgtatcgcactgacttgccgttgctcaagtaaataacctgattcctgaagtcaatgcgcggggagttgataagccaatttccgccaaaaccgaaataattgagactggggttacccggattggagtaaatgattagttcaaaactggcagggtcttgcaggccggcgctgattcgccccagcgaaacgctgacatcaacgcccccagtacgctcattaacagcgctagtcagcgaagacaggttataggcttcagatgtaacagttttaagatccatttataagctcttgctagtgtaaaattgcatcgacatcccatgtgatggcaggtgaatataagacgttcgctgaaggtgcgtaggagttatccgaaattggactgattgtctgtagggtatttctgacaaacttgccaatttcgcagtttgatatcgtgcaccgcacgtgctgcccattgcatgggagatcaatacatcgaaaccttgcaataaacgccaaagcccagtccttaagctttatgcgcgcgccgacaatgattcaatgagcactacgccatcgagccagaatggacaaacacaggtcatgggtatcgctacgaatccggacagcccatttacaggacggcatgaccaagcgtgaatgaattcagctttatccggcgagtgaccaggttcgcgatctgagcctggggcaacactccaccccgcgtctggcaagcgtcgaagtcagaggcacttgcaacgtgaacgtttggaaaggcctgatccacttcattcttcgctccatggttgagagggcgagaatgcgcacaaaaaagccctgaaccagtccggctcagggcgtgggagctgttcaaccctttgtacagggactctagcttatgggaacgccgggaggctcggcatgtaaattttaaataatcctgatcgaaccgtgagcgacgacccgggtacggaggctgaccccatagcggcgcctgtgcgacacagcaatgtaaaagttggcagcattaccaaccacagagggagcacgctggtcgacggacggagcccccccccttcagccgttgtctatttcgacacggacttcaatgagactctccacgccttttataaagatcctggcaacaacggcgagcttttcatgcctggtcgggcgcattgatgtcatcgtaacaagagcagatcgatggcgtgggcatcagcaaccggatcccgcgcaactgagaaaatcgccagggaaggtgattagagggtacaagtaccaccagcacgcgggatcacgaagcacaagccatgaccatgcgacaggcatggtcacagatcaaataacaccgttattcgactttggaagtgcgggccagccattcgcgccctttgagcatgccattccagtaaaaccaaggtaaaaagctcgccttgagataccagcccaggcgtcgagccactgtcggctcgagagggaacgtcggcagcaacttaccggcataaccgaactcggcgagtatcaccttgcccttctgcacggtcagcgggcaggcaccatatccatcatattggcgtgggaagggttgttgcttgcgcagggccaacacattttcggccaccacaacgacctgtttgcgcacagcggcggcagtcttggcattatctgtggagcagacatcgccgagtccgaatacgttcggataacgcacatgctgcaagctgtaggggtggacttcgcaccacccgtcggcgtttgccagcgaactctcgcggatgaaatccagcgccacctgcggtggtaccacatgcagaaagtcgaactttttcgcttggagcatgacggctccggcagcatccttgaccgcaaaccaggccgtttgggacggcccgtcgatcttcaccaattgtgaattgaaaaccagctgcgctcggtatttttcaatgtacttcatcaaggcgggaacaaagtccgctacgccgaataacgcggcgccggccaggttgaactcgacgtccaggtgcttgagcgtaccgtgtcgtcgccagtgatcacaggacaggtacagtgctttttgcggcgcaccggcgcatttgatcggcatacccggctgggtaaagatggccttgccgccactgaggcttttgaccagttgccaagtgtagcctgcatgcttatagctgtagttggacgtaacaccgtgctgtccaagagtttcttgcaggccttcgattttctcccaggccaggcgcaggcccggacagacgatcaggtactgatagccaacgctgcgcccgtcgtcgagggtcagcagatggttctcggggtcgacatggctcaccgccgtctgcagccatagagcctggcgcggcatcacgctggccatcggccgcattgtactcctcaggtcatggataccggccccgaccagggtccaggccggctggtaatagtgcttatcgcggggttcaatgaccgtgatgctcaagtttggctcacgcttgagcaggctggcgacaaaggcaatgccagcggtaccgccgcctatcaccacaatgtcggcactgatgatccggctctgaacttgttcgctcataggttttccttttggctatacagggggggggcaatcgcccggaaaaggcttacatccagcttttgtattgccacaaggctgaaggttttggggatctgaatcatttcctggccaggaatggtcgcaacgcatcgactggcctgcacattcgggcgctgatccgaatccgcacatcggttgcaaaggtggggactgtcagaaaaagcgctggaaacgaccgacgctgttcgacgtgatgtcgattcacttatgtgtccgtacctcaagtcgaatcaaacttcatccaatacgttgcgtatgtagggattttcttgtcttgcaacatcagccccgccccatggcagacggtctaatccagcgctgccaggagtttgaattgttgatttcaggatctattttttcggccacattgaagtcaatgggcggttttccagtatggggaactgcagacacagcactgcatcatgaatgctttaatctgatcagccttttcatcggggaaggtctgtttgaaaaaatcaagatttttccatttaggacgagatgcatttttggaggggcaagccgtcacgcaggttcagctgaatgaacatgagaaatgtcggtcaagtcaggcgagaacgggtgtgctgtttgtacccgaggcaacttgagagacggaactaccttaatggtcatgataccgatattcgcgtaaatgccgtacacgcagcaggcaaaggctggatcccatgcgttgataaacgatttcgtaatggccgaccggaacacgtcgaatgtcctttgagcctgactctgacaggcattcaccaagggtgggattgccgagaagagcgatcggcgccgctgtgagcttttgcaccgtttgcgcggcactcggtggactccataccgataaaaactggtacagctgcatcaggtcgagcacggccctgctgctccacatcagcgcgctctgcggcaaaggcgtggacaacgcagagtccgcattgaggctatcggcccaaacctggacgacgtgatggtcaaacacccggccagcttccacatcggccagtccttcacgggtcaatcgggaaaatttgtcggctgatcgggaggatgaaatccgcctgacgagccagcgtttgaaacgttgtttgtacttattcatcaagcagcttcccactcgtcgccctggcacgtgagccttgaaaatcaagcattacggtatataccctgaatgcggtatttctgatcatcgaaaggatgagaaagcgtgcgcagcgctcatacagctcaccgcgaagctgcgctctcttaatgctggatcatgagtttgtgcgtctggatcctgccttactcggtggctggactaggggcgtccgcgggcaccggtttaggctcttttcctttgccgccttggctgctcgtgacgctctcagagtctgtgtggggtttcgactccagtgcccgtactgatcggttagcatcaggcggcaagggaataggtttgacgcctgcgccgttaacggctgccgatgcccccaaaaagaagccgccgcgctcaatgatcaattgatccgtctgaatggtaccttgcacctttccgccggccaggatctctaccatctcggcatgcacctcaccctccatcagtccggaaacgatcagatggcgccccttcaccgtaccgcggatagcgccgttgaccccgattgacaccgtgttctggcagatgaccttgccgtccatgaaaccggcgaccaaaatgtttccctcgaccgacaaatccccctttaccgtgcaaccttcggcaagaagggtaagctggccagttgggaccattgatgactttgttttattaaagacgcccacgggacttccttctcttggctgaaaatgctttcaaagttagtggtcgaccaacgtgcaaagttgatcggatcaagcgctttgccccgatacagcacttcgtaatgcaaatgggggccagtactgcgaccggagttgccggtcagccccagtagcgtgccttttgccacatgcgccccgaatttgatcgacacctggctcaagtgggcataacgcgttgagaagcccagtccatgctgaatcagtacttgccggccatacccgcctctgctgttggaggcggcctgactgatcacgcctccggcagtggcataaacgggggtaccaatgcttgctgagaagtcgatgcccttgtggccgcgtatgcgcccaaggatcggatgcctgcgcagaccaaaataggaactgatccgggcgacatttctgaacggtgtgccattggggatcagtcccagcaacagcttgcgctcgttctgtgaagccatgacattgcgcggcgctactacgccaaccgctgcggaaactggccgtaccggttttaccgtctgacgcttgccttgggggcgttcggcctttgggctgcccggcttgctgtcaggtggcttgtcctcgagcagcagtgtgtcggggttcttttcatcgggaggaggatcatcgaagggctgttcactggagaccttctcagcggaagccttcccgtccagagcctgttgcagttcatcagcgcgccgtctctgcgcgaggctgccttcctgcaaggcggacaattgagctttggcctcggccagcgaggctcgcgtcaaaagcagggtggctcccatcactgccatggtacaaagtaaccccgtgcaggctatgcccacccacagtttggctttccacgttacgacaatatcgcgcgagccacccaggctcgacagcgtgataatcagttcgtccttcatcgtgcccgatagcctctgtatcaatgagcgcagacctgatcaatagaagccttaaacagatcgccatcggtggatgtaaaggactcggatgatttcgagtgcctggccgttatctgtgaagattcttgaaaaacgcccaacggctgtcacgacatcgttcgtgaaccgggtgcaggtgatggttcgaaatcacaggcaccagaacctcaagaaagcctgaccatcaaccgccgtccctgccaggccaggctgcctctgcctgccgggcttacggctcgtcacgcgcggccgtaccccgtgcaccgagaagagatgtgtcacgaatcccctgtcgttagacggacaatacgttggcaaatcgcgcattcgacaagacgattatcggcccctgccagcgcacaggagatcatctgttccttcaaagaatgtaggaaaatccttcagcacctgacctctgtgccaccgcttgttgacactgcccgaagtgtcgccacaccttttggagcgaaagacacgcactgaacattgaccgcaaccttgctgcacaacctgcctgggttacgatcaaataccgacctgacagctggtcgtcgcgattttgacgaacgcaacacacgtcacttggacttccctggccgggacaggcgacggtcgcagccccatcaagcactccaagcgcagggcggctgatcggacgatgactgccagcccttgtggcgggtttgccaagaagttaacaggccattcgtgaacaaccgacaagtcgtaagattgactcactgaaaaggctatacgacgcactgcaatactggcgcacgcacaatttgcatgttacttatcatatagcttctgatcgcatacaagagttaaaaacatcctaaaaaccaacaatcaaatacacttccaaaacaccttcacgacgcggtcaccacagtaggaacactcctgttatttgcctacccgttaatgatgattgaacaggtcgttcattaaaccttgtgcccctgcagccacttcgaaagagcggcgagcaaacacattttgcaacatctgccctgttaatccgaataattatttggattaacttgcacgccgactcaggaacaaggaagttgtgcaaacatgttatcgacgctatttcaaccaacgtcagccctgaaaacataatgcaagcgatcaagcgccttgacatgaccactgaagtcaaaaggctcttcgacgggctgcaaaaagaaacaatcgccaataccaaatcgcgccgagcggcgatgctggatatcgtcaatacgcatactcacaatctgacgattggttatacaaagacggcaatatcagtctcaagtcgccgcatggctcaccgtccgccgaactgtactccgtacccggatacagtgttttattcgccataaataatcagtcttttacagtcaatttgtacactgttgcacaggagcaattgacaccaacaagcagcgccgttgtcagcgagggcaatccgttgatggttgatggacgccacacgctgttcgattgccctccagccgcagcccacccgcaggcgtttatcggcagcatcaaccttccacaccgaagcgctgacatcagcgtatttgatcgtcagtcattacgaaaaatcgcctggatcccccatgatgacggtgctgcgcgttttctggtaagcctcgaattgctggaggcaacgcaggatccgggcatcggaacgatcgccgaagagttgatttatcactatcaccccgcggttgcctggaaagcgtttcaaaccatttatcagtttaatcgacagaccgccctggattatgtgccactgctgcgacaaaaccgttgcctcgatagcttgctggatcaatacggtaaagtcgcatgaacatttctaccttcgttgagcgtatggctcaatatcatctgcaagaccggttgtgcatcattgaagatttgcgacaactggcaaccaatcgctcgttgctcagtgagcacctctatcatgatattcaaaaaaatggattcagcatccacgacagtgtgtatggcgcttatggatttgtcttgcacagcaatgatttatttacgctgcgcctggcattttggtcacccacgatctcccaggatgagtgtggcacttttatctatgatctgaaccatactcacgactttgaaatctacgccgttggctacagtggcgacggttataccactgtcatgcgcaccatactggatcctgcgccgctgcgcgcaggtatcaaaccgttattgggcgaagagcgcgtcttgaaacttgcaccgggccatgtcatgcacatgatgccgctgtgcgagatacacaagcaacttccacccgaaaccttgtctgcttcgttgagtttgatcattcatcctcagcaggcgaccacaaccgaagaaacctggtgctttgacgaaaactatgtgccgacatatcccgacattgccacgcaggaagccgcactctttgagcaagcccagctcctgctccatcgcgggtaaccccgagtgcccgattatccaataaggagaaaaccatatgagccaatcgatgaccaactggacccagaccccgttgcttcgtgctggaaccagcgtgatcaacacaccggttaaaaccgcgcctgtagagcgctgcacaggcatcttcatgcgcttcaacgtaggtaacatccacgccatcaaggaaatccgcaaggcctcgcaacaaaactgaggacgatgagcacctaaagggcggtcggtagggacctgccgccctttcagctgttgagtggaatattgcgccggatgtttcataaagtcttcgctgctgcgccgccttgggtcgctgccccttgaggcaccgctcttgacccaaacgtcgcgccaggcgttcctcctggcagtggccaggctgaaccgcccccctttcattagccaaggccgccgctgttcacggatcgccagggtcccgtagtcatcatccaaatgagccggcaactgactcttcgcccctgcaccgttctctgccaggcgccaagacatttgctcttatggaccaagtgaaacaacgacagcatcggcatcgccatgccccacctgaaaagtgaacgcacggcgtgctttatcaaagcgtcgtggtcagcaccacagagggcgctgggccacacaagcaatcgtaaaattgctcagatcgtcgagtccgctgggagggcttgaagacggtggaggcgtgatacccacttggtagacatcctgccacccggttccgaagttacctgcaccactggcttgtggattagccgtcgagacacagaacaaattcccggagttctggtgcgaccccgataggccctgaaagtaaacgttgatcagcctattataatcgaccaccgagaaaaaatgagcggtttggttcgcctgatcggtacattcacactgggtgttgggaataatcaccggatcactccagcttgtcgcggtgggggctgtcggccgtgcaccagatatagaaaatttgccagttgctgcccacataaaacacatagagcacatcgttatacaccagcgcaacaggcgggctcccggcgttataaaaaatcaggttggacgtaatctcggtgtctccggcccagttcccgcgggtgtccatcgagttgaaccaaagctgtccccactcgtgtgcggccgtatggaacacaaagagacggttcgcgaatatcacaggtgaaggggtgtaggacatcaaggtgttatccacgctctgctcgccggaccagttcacaccatcgtctgtcgagaggtacgccagcccccccgcccgggttttcgcaaaatacatagaacttgttggcaaactcgatggcgctcggtgacgtattggcccactccacgccgttggcgatcaatttttgggagctccagcctgacgaatcatcgtatgtattataaaacaggcttccattacgggtttcgaagcagtagagcgtgctgccgaaagtggcgacgcctgggctgctgcccaaatccattgtcgaattcagcaaggtcgtattctggtacatcaaggacaactggccgttggggccggtgaaggcgcaaaaggtggtgccgctgtgcgtcacctcccctgcgtagccaggcttgccgggcgcttgcatcaaacaatagagattgccattgagtacggttagcgccggcgcctgtgacagagcaatctgagcgatttgtacaggttcggaccatgtgacgccatcgctcgtggcgacataatacatggtgttgccacctggatcgtaagagacgtacaacgagccgttgtggtaaaaggcactgggcatggagatggtcgagacattgggcaaaatgccgttgttgccccatgcgccaggcacccagttgcccgatgagtccatcatcatgccgtagacatcggtggggttaccgctgccctgaaaaaacacataggtcgtcaattgaaacacgacagcactgggtgaattgctgatccctgcgccattgatcttttcttgttgccaggaaagggactggttagtccaggcatgatagagctcaccgttgtttcccggcccctgatagaacacatgtatttcttccaggcaactattgctattgaagctcatcacggccgatgggttgcaggacatgatcgcgcccgcgttgggaagcacagtcgagggcgggcaaaagttgcctccggttgaatctgaaacgacgtactgtagtgtcccttgaggatgggcggcctcaggttccaagtgcaacagtcagttaatggtttcgagtttgttgctcgctgatagctgaaggtaatcaaccagtacttcgactggaaacttccaacccagcgtctggcgtggtcgagtgtttagcatgtcggcaatttcgtccagtcgctcctgggtgaccagggagagatcagtgcctttgggcaaatactggcgcagcaagccattggtgttttcgttgctgccgcgctgccatgggctgtgtggatctgcaaagtaaatcttcatgccggtgtgtgccgtgatttcagcgtggcgggccatttcactgccttggtcgtgcgtcatggttttcagcagtgatggcgccatccgcgacacctctctggtaatggcttgagcggctgcatcggcagtcggtgcgtcgagttttgccaagatcacgtaacggctggtgcgctcaaccatcgtggcgacagcagagcgattattagccccgatgatcaggtcgctttcccagtgccctggaacaaggcggtcttcgacctccggtggacgcagatggatgctgaattccgcaggatagcgctctcgacgtgtggcactctgggttcgcgggcggcgcttgcccttaccttggcgcaagtagctgatgagctggcgcttcagctcccctcgcggataggcataaatagccaggtagatggtttcgtgactcacatgtcgctcggggtaatcgggccagatactgcgtagtctgctggcaatttgctggggtgaccagccaatgcgcaacatttccatgatcacttggaacagttcagagccagagcacaagcgagactgacggcgcggtttgtgacgtagcactcgagccctgcttgcggcttgagccgaatcgtatcgtcccagttggctgcgccgtctgatctcacggctgatggtgctgggatcctgagtaaaaccgcgatagctcgcagagtaagttgttgaagctgcatcaccatgatggcgacccgctcctcagtgctgagatgtgtgtacttcgttggcatggcaacaccttacatcaggtgttgcacatggtccttgagaccgccatggcagttataggtaccggcgtggcattctggaagaagaggtagctttttccacccatgaaagtgaccgaaccggcccccgcacacgccacgccacgccacccaaaagcgacacgctgttggaccatgaggtcccgtcatatgtttgataagcgatagtccacggttcgcctcccccccccagctgctcaaataaaacgcatacagtaattgagtggtgcctaagggcggaaaattaatcgcggtcggagggttgttgacatcctgcacatactcggcgtcatgtacaaccgcccacaattcctgccaaacgggaaggtaatcggccacaaactcagttgcccaaagtgccagatcatactcggccattggcggccccaaaaacagcagatttacaggggcgaccaccatactccctctatcagatcggttttaattaactaaatagccattgaacgaatcgctgaaagttatgtcgctatacccgcgacgatctgaaatcatacataacggtgacgttatgatacgtcactacgcttgcacccttgcctgatcaatgacttgataataaattacaaactcgtgtcgaaaaacctaccccttttcagacactttctattgttttttaaacagcgctgtatcactaaacgtcctgaatggctgtttggggtttaaacatgcttgcaggtcatttagttctaatgagagctttcgctaccagatcgtctttaaaattttagatatagcgcccttcttttcgaaaatttcacggcctgccgtagctctacaagctagcccgagagttacacgcccccgcagtccgctgcacatcgacaggcgtcgtccggatctgaaggatctggtactgaacgaaaagaatctcaaccaggagctatccacctttcgattttgaacgagattccggtcttgccggccagaggaaaacaccacgcgtccctattgtgcaagggctcctggtatcgatgttcgataccggctcgtcctgtgtgatttaaccgcagcgtgataggcgaggcggcggatgggcgagtgccgcagcgataagtcgaaccaacaaaaccgaacaggacgtattttacctgaccaaagcacctgctaaggcttgagctcgcgtgtgcgacagcccgccgagctcggttgaacactgcagacatacgcttgaagaccggacagcttcacggcgcaacgatcggcgtcggcggtgacagctgcaagagctgctgcatcctgcgggtatagctcggctcgctgggctccatcatccatgctggcggcgttggcggttgcaggcaggtggccggcggagcaaccgagaacccggactgacaaccgctgacgagtagcggcaagatcagcggcaagctgaaggttatttgcttgcacatctttgagcgcctcataatgttgttgatccagttgcgtgattttttgggtttgttcctggtgcagttccaactgcgattgcaactgacgggtagcggcatgactgatttgggccagggtgtcggcattggcccgctgtatcgattcgatttgggcaccatatcgccatccttgaatcatccagctggcagaagccgcggtgacgacggcgataatcaacggaatgagcctgagaaacaaagcagtcatgtacacctcctggcctggattagcgaaacgtaacttcatcgcctcaccaacatacttgcccaatgttttcttaataacaaaaaacagtaattaaatattttcacttaacagaatgataccgctcctgccatcggttgtgacttcaacgaaacggatcagcccaacgaggttacggttcatgttccacgccgcagctacccatatccggaactaggcagactggcgcaatggtcacccgcgccttcggtatataaccaagggtggcgcacatggcagccgttttgaattcgcatcgagacatcagggcggtacacaactaacaatcgtacagtttatcgacaagtctactcagacggcgcgatggctgcccgtcttctgcgcgcaacttccattatccacaagataaacggctgctaccgactgactgtatgggctcgatcttcgatctggcctaagcaataaggactacacggtgtcaaactgttcaatgtatccgcctatcaccctcgtctcatcattgtgtcaggccactagacaggcatgtaagtgcatcattgctgctgatctattttttcggtctcttggccgacggtgggagttttatagatagcgtttgcataaaaataacgacacattggcccccagccacccccccaggctcgtgacgacaccagccacttctgcgggcaatgcgaagaagtggagtgcccgcagcattagataccctgcaaacgctgcacctactccctgctgcagcgtttcacccaacgtcattttctcccgaacgttaagcttgcgcatcatatggcctaccacgccaccgacgagggtgataaacatatacccccataaatggaggaatacctccagcagatcgccgtttcccataatgtttctccgtcaggatatgaactatttgtttatttcattggagcagaagccgcgctgcacttcaggcttcgattcacgcgttcacggtgctgcatgggaaccccgcaggatttttaatcgtatagttggaaaactgtttacgtataaactcaaacccttgaccccgtaactatgagtcgaatcatgaccgtttagttgaacagtttatgcaccgcttagatctaccctaatcccgacaaaagcacccagcaactattagtacgaattcagactattgattcgcgtcaagtcctgatgagcgcgaatcggtttatgagtcaagcagctggggtaagtattttggatatcaagggtgtgataatcatctcgcctgactgaaagcaagcgacggagccctggaaaaacatgacacgttcgactgacgcgggctgtcaatcaatgccggtggcgcaagctcgctgcagaaccctgcactgttttacagttgcacacgcccattccgataaaatgcttcttatgattttttaaatggcgctggtcgaatgatccgatgtcgctgcatgccagttaattactgtgtgtggaagcggttgatagtgattaaggtagtacgtggctgttcgcggccctgtgtgcagcccctctacccaaatggcgaggaaaatatcgcttcggctggagttagggattcccctacggcgaattcggcatttaccggtcgtaatgagcgcccaaagtaatcatgataaattcaatttaatgtcaatttaaggctggcaatcctacgcattgggctttttgttgtttctgtcaaattcattgtgaagcgcgtatcgacgtccttgtttttgcacatgacagccattcgccatcatcgaggtatcaatacccagcgctttacaaggcgaaatcaactgggtcggatattcaggggcgtgcattttcagcagccacgctgagtcgttgagcctcagcgtcggcgttggctccttgaatggagtcaaacgcgttgcgccaggcaactgctcattgcctctggtgaacgccgattcgattgatcgtttttggggccgcgctttgcaagggcaatggttctgcgctctggaaaacctgccccctgggtactgagtgcagccgctggcacttgcacctgcaaacaattgaagccggacagacatcagcagggcttgcatgcaacggcgccagacgccgcccagccgccacgcactctcgatctgccatgaacgggcggggcgaagtttctgcgcgcagttttgaaggtcattgatatgaaaaggatcaaaaatacatccagcgagcttagtccagaatcagatgatcgaattcttgtggctgatgacaatgccgtcatgcgcaaaaagttggtgatggagctgacgaacaacgcgtttaccgtcgtgggacaagcccgcagtggtgttgaagctttgcgtctggctcaacgtgataacccctcgttgatgctgctggatctggatatgccgctaatggaggggttgtctaccttgcgtcgattgcaggaggtctgtcctaacctgcccgtgctggtctacagcatgctcaatgcaagcgtctacagttatcgctgtttacgactcggcgcccgcggatatatccgaaaaagcgatggactatccttgattgttagtgcggtctcgcaagtgcttcaggggcaaatgctgtttctcagtcatccaacgggcgaagcttccgatgagttatctgatgacgagattatcgtactacgctgtttggttcggggggggaacatcgacagtattgccgcggcactgatgatcagcgctgctgaagcggcgcagctgcatcaacggcttaacgccaaattgagcctctttactcatcaagagttaattcattttggtaaaggcttgacgctgagctgaacccgattggtcgcttaacacgattcttataagacaaggagttgtcatgccgagacacccatttttcatttcgcactgggcgcgatgcgtgaaccgccagtggttattgtcgtggcgttctttgctgcttgtttgtgtgctctacccctttctaagtcagccagccaaagccctcgaagcccctcaactggatccgcaagcggatctgccgtacgtcaggcttgtgctggcggctcatgagtcgacctggctacagtcgcgtcacgtgatccgtctgggggtcaccgtacacgactacagccccttattcctgccgcaagggcaaaagatcaagggggtgatggcagactacctgtcgattattgcccagagtcttgggctctcggtggaggtgaaagtctattcaggctggtcaaatgcgctgaacggtcttcgttccggcgaggtggacgtgctaggcctgggctcctcctacgaggcccagcttccgggcttgttgctctccagcccttacaccgccaaccagccgatactggtcgggcgtgatgatgaggccgcctcggcaccttcccccagactggcagccgtggaagggtatgcctcacccgccgaactgcaagcgcgctttcctgacgctcagattcaggtctattcgtccgtgcgcgaagcgttgtatgccgtggagtacaagcgtgctgactgggcggtttgtgatgccgccacagccgcccaccacataggcgtcaacgagctggccagcttgcgtatgcgccccctgaacctgccggctaccggctacagttttgtgtttcgtgaggccgacgctttgctgctggggttgttcaatcgggtgattgccgatattcctctgggagcacaaaccaacatccgcgcctattggggaggcggggtctactttaacgacacgcaaaagccgctctacaatccggagcagttaagctggctggccacgcatccacagatccaggtggttgccagtggcggtaccccaccctacagttatttcgacgagggcagcaactaccgtggtctggtggcagatttactgcgtgaaatcagcctgcgcagtggtttgcgttttaatgtcgcggagcgcagcacagatcaagaggtcatggatgccctgcaaaccggcaaggcgcagctgaccccgcactttctcatgacgccggaacatgagggcttcctgcgtttcaccgagccttttggcgcaagcacctttgctctggtcggagcccgcggcagtgccatcagtcgcctggatgatctacgcggcaagcaggtatctctgactcagggctcgcccgtgatcccttttttgcgccagaactaccccgacatcgtttttgttgaaaaagaaagtccgctggagagcttgcaggcggtcgacagtggtctggtggaggcggccgtggtgctgctgccgatcgctcgctcgttgatcaatcaacagtttgctcaaagcttgagtgtgctgacctccctgcccgcgttgcgggccaatctgacctttgccgtgatccgggattcgtcccccctttttgcggtcatcgagaccacgctcgcgcgcattgagcctcgcatgatgggcagcctattggaacgctggcaggacagtcagcctgatcaagaggacttgtggggcagccagaagtggcgccaacgctggacggctctgggcgccggagcagcgattggaatgctgatgatgtggtttttctattccgtttatcgtcgactcaaggtgcgtgccgaacaagggcgtcaggtgtttcgcagtgcgctgctagacgggctgcctcagccggtcgtggtgcgagacatcaatggtgcgttcttgctgtgtaacgatgcgttctacagcgtgtttggcttacaaccttcggatgttcttggacgcaagtggaaagaggtcaatggcctggaaggtgtacagaccattgacgaagagcagacatacaacgccttgttgcaaaccaacgaggcggacgtgcgcctggtcaatttcaccatcaacggtgtggcgcgcagctatcgtcaatgggccgtgccgcacaaggagaccaatggacggcgcagtattggattgctcatgggctggattgacatgtccgacaccgagcgattgctgcagcagttgtatgccgtacgtgatcaggcggtacaggccagtgaagcgaaaagccgctttttgaccgccatgagccacgaaatccgtacccccttgaatgtcatcatcggcctgttggagttgacgctggcccgagtggacaagggggaggattgggatcgtccggccattgaggtggctcactcaacgtccagcgctctgatgtttttaatcggtgaaatccttgacctgtccaaaatcgagtcgggtaaattaattctggagccgcaacgcaacaatcccaaggagatcgtggaaactgtagagcgggtgtttcgggaagtggcacgccaaaaagggttgtacctgagactggagctgcaggtggagtccgataaagatgccctgatagacggggcgcgcctgaagcaggtactgttcaacctattgagcaatgcgatcaagttcaccgatcatggcggagtcaaaatttccctgcgtgttcgggaaatcgaagccgagctaggaatggaatttatcctggaagacaccggcattggcatctcggccgagaaccagaagctgctcttccagccatttagtcaggtccgcgggcccgcaagcaatcgtggcggaacggggctcgggctagtcatctgccaacagttggtcgagctgatgaaagggcatttagaactgacaagtaccccgcagcaaggcacccgtgtcacggtgacgctcagcgcgccggccctggagatgagcgccccggaacctggtgaaggcaaacctgccaatccccgatcggcattgcgtgtcctggtggtggatgatcacccggcgaaccgactgttgctgtgccaacagctcacttttctcgggcacaccattcatgaggcggaagagggtctgcaggccttcgagctgatcaaggtcaacatgtttgatgtgatcatcaccgactgtgatatgccggtcatggacggttatgagctgacacacctgattcgacaggatgagcacgacaaaaaacgagtcgccagtctggtgattggttataccgccaatgcccaggcctcggaacgacaacgctgtctcgccgcgggcatgaacgactgtctgttcaagccggtcagtctggacatgctcaaagcctgtctgagcgatgttctggtcgacaatcatccggcccccgtctgcccggtatcggcaactccactggcagtcttcgatctggccatcttcaattcgctcaccggcagtgatccgcatctggagcggttgttgctcgagagcctgcacagcaccaactgccttgatctgaagcagttcgacgagctgttatccgccagccaatggtatgagctgggccgcttggtgcaccggatcaaaggtgcggcacgcattgtcggggcgcaggtcgtggtggaggccgcagaggcctatgcccagcatcgctatgacgaattgtctgaagaagaaacgttgaacagtgcggcgcaggtgcgcactgccatcatccaattgcaagaggcggttagcgacagactgactatttgagggggtgctcatgggagcggcgactcgatccgacctgcgtacgcgttctgctcccggccactgatcatcactgaccggagcgcaattgatcccagcggaaggaaccgttgccttcaaccactaccagcaattgatgcaggggctgtctctgcccctcggtcatgctgcggcccaaggtgagtcaaaggtggtcttggacctgcgcagttgaatgataaacagctcccagtcgagtgcttcatcaaccgcgccgatgagttcagccctcactccgctgggcattgacagccttgacctgtacggcgctaagttccagaaggcgggctcgtaccggttcttcgatgaagcgcgacagctcgcctttacgggcatcgcctaggccggccagaaacatgcgaagcgattggtcgtgtcagtcgagaccgcgacgctccagcaagtggtgttaatgaagttttcgtcgagaggtgtttgggtgtttatgcctatcgcctgtcactttgcaacgttgcctgcagagccggccctcgaggggcttaagtgaactttccgttccgttgctcgccccaaaatcgccgatgaaacttacgcaacaccgtcattgctggttcaaacacctcgcacaatgaaattatgccagtgccttgcccccctattggcaagcgctggataacctttgcgactactcatgcaacagcaacacgcgtaccgaaggcacagatgttgcgctcactctggaaccgttttctcaaggcctacgcaagttacccctgcatagttccactcgctcgagaggagagcgtaccttgaacaaattgaatattactgacctcaaatccatgcatgttaattccgttaacatccagcggcgaataagagacgctgacgggaacagggctgccagaggtaaaccccgcctgaacgtaagcctcaccatcatagccgacacccagtcggacattgtctatcgcccattgatcagaaggcttgttcccagcatttaaaactgaaaccacgaacgaccgattattattgttaattggattgccatcgagggagatcagcaggttaaatcgctgcttgaatccatcgccttgcgcagtgaccaccagttctgcataacagtccaagcctgatgccgggcacgagcagaatgttctccaatagaattcgccatccaccgagtaggtatttgttatcctgctgggcatggcaggagaaagtatcaactgtttttgcgaaagggccagtccagccccacagttgatgccgacgccatctccaccaacgagcagcgcccctccaaccttggtcatgacctcaaccccagtgacacccaatttgacaccattgccaggcttgacggctacaccattgacatcaactgtcagccccatgctgggggcaacggtgacattcacaccggcaggatccaaatggatgccgttgccgggtttcacggccaccccctggcatcgactgccagtcccatgtcggcagcggccgtcacacctacgccggcagcgcccagataaagaccgttacctggtttgatcgcaagaccgtttggcccgacagtaatccccttgtcagtttcgactgtaatccccacacccgtatcgctaacgctaattccacccgccacctgcggcagcactgccaatttaagattttcatctaactgcaggcctcggccttgcccccggggctgattgggcgaaagaccggccacttttcgtccaatatcggccaagtcgatcaagtcagaaaaattagaagccaacggtacttgttgaggaccaaaggcatccttgatgcttttcgactggtgagcctactgatgcaattacttcaatcatgcaagaacccttaaaaggtgtatggatcgatggcaagtgaaagcatgagcaatgtaactgggagcacaaatatctttcaatacctccaacagtctgatatcggactgcgtaaccgtcagggccagcgcagccagaatgagttccttgattaataaagagaagaccccttacatccaaattagctcagataaaagttaaccgggcttcggcttatccgagcattcatttaattaaactgaatacaccttatgaacacctgaccaattgatttttttgaacaaatcacccagtgagtgaccgcccaaagttcgtacaatacctgcagggttttcctattttggctcgccctgtcttaagaaggcttgctcctatggtaaatatcgtacacgttcgacattattcaaagagaatctcgttaacaggtgccacagcgcggcggcgattatggatagtttgtattacacacgttctatccgtcgttatctttgacggcgttgttaatgacgccgaccactcagtattgagtagagacgccctcactgagggttgtccaaggcaacccagtggattcgaacaggcgcaactgtttcggcctcaagccacacagagagagcgtcaaacgcgcttggaatgagcaaaccagggcattcgaaccttcatgcccgacgacatcgccctataagggaggcgtcggaactcaccagactcgacgtattcagccatacacaagccaaaacaacttgagagacttaggatgaccgacgaaacagaaggcccaattgcaaccgaacacagctccaatatccccctgacctcagtcggcggcgttttttaggcggggtcgctgtgcttggcgccggggccaccctgagttcctgcggcggcccggttgagcagccaggtccggtgaatcgtgaactctctccagccgagctggataaggccttgcacgatcatgtgaagaatgtggtggtgatctatggcgaaaatcgcagcttcaacaacctgtttgctaactttccgggtgtagaacatcctctgtcttcactccagccggccgactaccagcaacgcgaccgcgacggcagcgtgctcgataccctgccccaggtgtggggcggcgtgactcaagtcgggccgcagacaatcgacggcgtggtttaccccgtcgccatccaatatcaggaacatttgcctaacgcgccttacgcgctgaaaggcccaagcggtgaagacctgccattgggcgtgattacccgcgacctctggcacctgttttatcagaaccagatgcagattaacggtgggaagaacgaccagttcgttgcctgggccgactcgggggcgttaacgtttggctattacccacaaacgcgctactcactgcgcctgtgggatgtcgccaaggaattcgtgctctgcgataatttcttccagggcgcttttggcggttcctacctcaaccaccagtacttgatcagtgctcaggtgccgttatacccggacgccgcccattcggtcgccagatcgcaaatcgcaaccctgcagagcgacgatccgaccgatacacgcctcaagccgctggataaatccccggccagtgcaatgaccggcccgccgtaatttggtcccagcgcactgacgccggacggctatgcggtgaataccatggcgcccccttactggcccacctggatccgcgcccctgagcacccgggttacgccaaacccgatctacccaacgtgttggtacctcagtctcacgaacacatcggtgacaagctgtcgaagaagaacgtggattgggcctggtatggcggcgcctggcaagccaccatcgacgaacataaagattcaggagcaatccccaagatcccgagtttccagtaccaccaccagccgtttaactacttcaagcagcaaggcccggagaatccgattgagcgcaagaaactcttgcgcgatggcggtctgggcgatgaaccgagtaccaaccacttcctggctgatgctcaggcgggaaaactgccggcggtagcgttctacaagcctcagggcaatctcaacatgcacgccggttacgccgatgtggccgcgggcgatcgccatatcacccgagccctgaaagtgctaaaggaaagcccgcagtggaaaaacatggtggtgattatcaccgtcgatgagaacggcggctggtgggatcacgtcgctccacccaaaggcgaccgttggggctcgggcacacggattccggccgtggtggccttgccgtttgcacgcaaaggcacggtagatcacacggtatacgatacgggatcgattctgcgcctgatcacccgattgttccagttggaaaaactcgacgaccttaagctgcgcgatgacgcaatggttgcacgcggccaaaagcccatgggcgatctgagtaacgcattgcaatttaaggtgtaggttttcccaatagcggggaaatagcctgaacgacctcaaggtcgttcaggcattcaacaaggatcgctttcgcggtcacgctatatgcataagattctaggcaaaaaagggctcgactcagacagcctgcagcaggatgttactttccatcctgcaatacatgtctccgagtatcaccggaacggaaatttgatcattgacctcgatcgtaagccctgcccaagttacggtgagcgcttggaaaaaatcgtcagcatacccactgtctctagagtactgcatacgacttggcttcacccccttgaggaaaaaaggaaactcatcccccttcaatgggatggcaccatttcttccatataaataggcacaactgtagccctcaatgcttttcgctataaatacagttgcttggtcactcactccataaaattgcgcagcgtgtaatgcgcagaatattttatatatgcatcgtctatcagccctacgccgttggcatcaactttgactcccgacgccgtattcgcaatgccccctattccgctgccacccaccaccaaccctttgttcgcctcaaccttcacttccaaccccgtaggacccacatcaatgccattgcctggctgaatggcgaggccattacttcccaccatcaaccctttccccggctcggtcgtgattccaacgcccatgctgctgagattaataccattaccgggttgaatcgcgagaccattgatcccgacagcgagtcctttgttggcctcaaccgcaagggccaagccgtcggcccccacaataagccccttgcccgccttgagggtaatgcctacacccgcggagttgacatcgagaccactggacgcttgcgggagcaccgccaatttgaggtattcatccaattgcaacccaagaccttagccttgaggttgaacgggtgagagtcctgctgcttttcgcccaacatcggcgacatcgatcaagtcggaaaactgggatgccagcggaactttctgaggagaaaaaatctttgagcttttctgacggggaaccaacaggcgataacaatgcaaccgttttttattctcaattttaactagggatctgaaaacgccaaaacatcatgaggtaataacctaataggtttcaatgtctttcaagtctgataacagactattgagactgatggaaaatcgcaccgctgcgcgtataactgttgggccacctagggggtggtaattcatttattcatatttggagtgagtggtgatgcccagccaaatccaccgggacgtacaaacaattgcgcactgtttcaatgatatcaagacggttaaggcgtcggctaaagcaacgacaggtgctttggggcgcggtacaaaaagtcttgtggcgcaaggtgcggcgaacgttgcgaccgcatggacgattgcccccgttacaacgctgatacactcaacacctgtattgaatcaggtaccgctgctgagcacgcttgttgcctctattgcgcaaaccattatcagtgatatcaatccaacactggtcaaggctaacgatattcagggatggggagagtttttcgatagcgaggccgcgccactcagtgcactggactatgccaaaggtccccttggcatgattgccaacacggttgcaggcgtcacaaaccccattgataccagtcgaatcctcagtgcgatggacgaaacggacaaggtatggcggcgcgcagaaggcattccaagggatgccttggtggaaatgcttgaagaagttggaagactgaagacacaaatcgacaagttggccaagaaggcaaactccgcttttgacggggtcgagacggccaaaggggctggagcgagcgtgacaccccgagacgtcgctagcgccctgtataacaagaagtttagtgctggcggagcagcggcattggattatcaggggcttcttgtcaaaaacattgccagccctaaacataattttttatcgatcagccgcaacgatgtcctgaaagccgaagtcaaggcaaaaaaagagctgtatgaacttgagagggttcttaaaaatatgcttcatcccgccgtccagtggggggctaagcagaatcagaaagcctatgcacgaggagagcgcgactacgtagcacccccggcatggcctgcgtcggacaagcttaacgacattccgtttatcgatggctaaagcatccagggcccattgaagcgtccccaagcccatggcgcgcacgtgatgtgcccttcacaaggcttttttcctgcaacggaagcagatcgccagacaggctagtgccaacgtctgtaccctcttccctcagccatcgcgcgtcacaatgcatccgctgcagggaagcgtcccaggaaaacgtaagccaaggccgtgcgccatgaggcttcctctccacaatacgtgaatcgccccggcttttgtggaggccgtttcgtttaagtcaggccgccatggcctgacctgcttgttgctggtgaaagtttgcctcagcctccgcgggcgggatatatccgattgagctcagcaggcgttggtggttgtaccagtgcacccatttcaaagtcgccatctcaacagcttcgcggctcttccatgattgacggtaaatcagctcggccttgtacagcccgttgatggtttcggccaaggcattgtcgtagctgtcacccttgctgccaaccgagggctcaatgccgcctctgccagccgctcggtgtagcgaatagagacgtactggctgccacggtcgctgtgatgaatcagtccatcggcacggtgtggctggcgggcatacagggcttgctccagggcatccagtacgaagtcggtcttcatgctggtactgactcgccagccgacgatgcgccgcgcaaagacgtcaatcacgaacgccacgtacagccacccttgccaggtcgagacataggtaaagtccgagacccagagctggttcggacggtcggcatggaactggcgttgaacacgatccagtggacacagcgatttgtcgctggccaccgtcgtccgcacaacctgtccgcgccttataccctgcaatcccgcctgccgcattagccgctccaccgtgcatctggcgatcccaatgccctctcgctgttgggccgcatgcctgcggtaaccggacggggcgatctgcaaaacacggcagatcgactcgaccccgagacggtcacggtactggtcgacaaaggccctcaggacttggtacggcggtcgagttccgcctgggcaaaatacgcactggccagacgcaggatctcgttggctttgcgcagttcgcggttctcacgctccagagccttgatgcgctcgcgctcttcggtggtcggccccggacgctgaccggcatcggttggatgacggcgaatccagccatgcaacgtttgcgctgcacagccgatcttcggggcaatggcctcaatggccgcccactcggacgggtagtcgttcaggtgctccagaaccatgcgcacggcacgttcacggacttcaggggaataggtcgtagtctttctcatggcctcatcttctcaagagttgaggcctccacgaaacccggggcgattcaatgaccaagctcccgggctctctacctgagtacaccgaaagcgattttcttaaactgctcgacgaaatatgcaatgcggtgggcaccgagaaatatcaggatcagttgctagagcactttattaaaataactggcaatcccgccgcatctgactggatttactatcccgaggatggtgaagacgactcgccaaagggaatcatgaaaacagtcaaagactggcgcaagaccaacggttttccgggtttcaaggaaccctgaatcaatggccttgaagcgccattccactaaacccatcaaagctgaatcaaggacgatatgaattttttcagccgtatcgcaggtctttttgaccgaacccccaaggagcaaattgccggctattccctgtcagaactccgagcggttttcaccgagccccttaaacacaccactcctgccctaccccttccactgcgcgcggtttctttggaagacacaggcgtgccggcttattacggcgccttgctgatcgatggaagcgacagggattctttccaggcacttatcgaatccagcttcaccctggccgacgagcgaagcttcaacgacctccccgtcaggcagtatgaaaacctccaaaaccaccagcacctgatctgttttatatccacccgggaactcaacgccgtcacggtacgcctggtaaccaacagcactgactttctcgaagccattcagcgccagcgtttcgccgttccaccgccctgggtagccttcgagggttacgaccctgcatggtggggaacgcagttgcaaggtgcccagggctactacaacgaccagtacttcctgccgttttttaccggcttgggcgagaccgagaagcaggcctatttcgctcgctacactgccagccaagcgtgggccgccagcctgatgtcactcggtgatgagtgagagcaactgatgccgcaggccgcgaccacctcccccaaccacctggcccgcttgccgaaaagcgcaagacttcgcgctgaaaaaccggataatggccgccatttcgttttgctcgttattcggtgtgccccatggaaatcaaggtcaactttctcgacaacctccgacttgaagccaagttcgatgacttcacggtggtggccgatcaacccatccgctacaagggcgatggctcggcaccgggtccgttcgactatttcctggcgtcatcggcgttgtgcgcggcgtacttcgtgaagttgtactgcgacacccgcaatattcccaccgataacattcgcctgtcgcagaacaacattgtcgatccggaaaaccgctacaaccagatcttcaagatccaggtcgagttgccggcggatatctccgataaggaccgccagggcatcctgcgctccatcgaccgttgcaccgtcaagaaagtggtacaggccgggcccgagtttgtgatcgaggaggtggaaaacctcgacgccgatgcccaggccttgttgatgccgagcgcgggctcgcacagcacctacatcgccggcaaggacctgccgctggaacagaccatcgccaacatgtccggcatcctggccggcctgggtatgaagatcgagatcgcttcgtggcgcaatatcgtgcccaacgtctggtcgctgcatatccgcgacgcgcagtcgccgatgtgcttcaccaacggcaagggcgcgaccaaggaaggcgccctggcctcggccctgggcgagttcatcgagcgcctgaactgcaactttttctacaacgatcagttctggggcgaggagatcgccaacgcgccgttcgtgcattacccggacgagcgctggttccagccaggccccaacgacgagctgccgagcgaaatcctcgatgcgtactgccggaaggtctacaaccgcgaaggcgagctgcgcggttcgcacctgttcgacaccaactccggcaatgaagagcgcggcattgtttcgctgccgttcgtgcgccagtcggatggcgaagtggtgtacttcccgtcgaacctgatcgagaacctctacctgagcaacggcatgagcgccggcaacaccctggctgaagcccaggtgcagtgcctgtcggagatcttcgagcgcgccgtcaaacgcgaaatcatcgagggcgaattcgccctgccggatgtgccggcagaagtcttggccaaatacccggggattctcgccggcatccagggcctggaagcccagggctttccggtgctggtcaaggatgcgtcgctgggcggtgagttcccggtgatgtgcgtgaccctgatgaacccgcgtaccggtggcgtatttgcctcgttcggcgcgcacccaagcctggaagtggcgctggagcgcagcctcaccgagctgctgcaaggccgcagtttcgagggcttgaacgatttgccgccgccgacgttcgaaggtcaggcggtcaccgagccgaacaacttcgtcgagcacttcatcgactccagcggcgtggtgtcgtggcgtttcttcagcgcccagtcggattacgaattcgtcgagtgggacttctccggccagggtgaagactccaacacccaggaagccgcgaccttgttcggcattctcgaaggcatgggcaaggagtcctacatggcggtgtacgagcacctcggcgccaccgcctgccgcatcctggtgccggactactcggaaatctacccggtggaagacctgatctgggacaacaccaacaaggcactgttcttccgcgaggatatcctcaacctgcacagcctcaacgaggaagaattgcaggcgttgctcgagcgcctgatagaaagcgaactggacgactacaccgacatcaccaccctgatcggcatcgaattcgacgacaacaccgcctggggccaactgaccatcctggagttgaagctgctgatcttcctggccttgcagcaatatgaagaagccaaggagtgtgtggagatgttcctgcagtacaacgacaacaccgccgagcgcggcctgttttaccaggcgatgaatgcggtgctggagatggaactcgacgacgacttggacctggcggattacgaaaccaacttccgccgcatgttcggcaacgagcggatggacgcggtgattggctcggtgaatggcgatgtgcgcttctatggcctgacgccgaccagcatgaagctggaagggatcgaccgccacctgcgcctgatcgacagctacaagaagctgcacgcagcgcgggccagggtcgcggcactttccagctgatggccaggccggggaacagcgcccgccgttgaatcgacaggcgctggccccacaggcataggaaatggcccgggcgatcagcgggccaacccgccggccccaccccgctgccggctcgaaccagctacttctcagcgaccttccaaccccttccctgctagcccccggcgacaccttcctcccccggcgccgtattgccggcaatggcagccccgaggaagtacagcatcccgcccgcgacgataaacagcatcagcatgtagaagatgtattggggcggctgcaccgccaagaccgccccgcacaataccggccccaatgcagcgcccaggttgttcaggttctgcgccccgtaatacatgccccgcaaatggctgggggcgatgttgtcgatgaacatgtattcggcgggaaacacgataatctcgccgagcgtgaaaatgaccatggcgccgacccagaacaccagggtggtcgacagggcgaagcccgccagccccaggacaaacataaccagcccgccggcgagccacaggctcaagtgttgctgggagattttcctgccgatgaggtattgcaggctgatcaccgtcagggcattggtcgccacgatgctgctgataatccggtaggcggtttcggctgtggtggtcaccaccaggtactgcgagaggtaggcactgaactggccgaagaccacggcgctgagcagcccgcccagggtaaagcacaccagccggcgatcgctcagcaacagcttgcccacggccaggaacggcgcgcggggctggcttggctcaacgcccgccaagcccctgtcgccccacacgaagtagataaacaagaaccctgcgcccagccccgcggacaacagaaaaggcaggctgatatccagcccggccagccccgcgccgagaaaggggccgacggcataaccgatattggtcagcgtgtatttgatcgaaaacacttcgccccggccagcgacggggagcaggctgccgaagctcgatttcacggcgatatcgatgaccgcgtaggccaggttgatcgacaccaggcacaggtagaacagccagagatcgcgcgcgacaaaggtgccgaggaaacccgcggtgaacacaccactgcagaccaggatcagcctgtagctggacatccggtccaccaggaacccgccatacaggctcaacagcgagccaatgatcagcgtgctgccgatgaccaaaccgacatcggcgatgctcaagtggaagtggcccgataaataaatgaccagataaggcagggtgatcgcgcgagcgagggtcaggatcagggacgctgaaagcagcaggtttaccgtggtcggatagtttcttagcgtggccagcatccttgcctcatcgttatcgccattatttttgtcgggttcgcgctgtggcaatcgcaggaaagccggcgcggatcaagcatactgctgaacccgattctcattgctgatggtttttaccgggtgtgtggagccagattcacgaataaggaatgtctatgttttcctccgaacgcttgaagggcatcgatgtatttgtctgcgtggccgaatctggcagcttcacggccgccgccgagaaaatgcacctgacaggctccgccgtcagtaaaagcatcgcgcgcctggagggccggctgggcactcgcctgctgcatcggaccacgcgacgcctggcgctgaccgacgcgggaatgaccttctatcgcacctgtaccggcgtgctggccgacctggaagacgccgagcttgcactgaaggccgaagccagcgaggtctgcggcagcgttcgcatcgacctgccaggggcttttggccgcgcccaggtgctgccgatcctgctgcgccttgcccaggatcatccggcgctgactccgcatatttccttctccgacggtttcgtcgacccgttcaaggaaggcgtggacatcgttgtgcgtattggcggcgcggatgcctggcccgatacgctggggcagcgttgcctggcccgcgaacgacacctcttctgtgcctcccccgcctacctggccaggcagggcatcccgttgaccgaaagcgatttgcagcagcatcagtgcatcgcttatggctgggtggacggacgaaccaatccctggaacttcgccgacgaccagggcgccacgacgcgccggcaggtcgccgcccagctcgtggtgggcaatggcgaaggcatcgtgatggcggccatggccggttgcggtatcgcgcagttgccgtcctggctcatccagcggcagctgggcgaaggaaccttggtggaggtgctcgcccatcgggcaagcgaggggatgccgatcaacttggcctgggtcaaaagtcgtgaaacgcagcccaaggtcagagtcctgctggaggccctggtcacagggctgacgccgatagacgacagcgacctgaccgccagccctgcccgctgacagactacgatcggccagcacctgccgccggccgatagccgtgcagtttttgccagggcctgaaatgccccgcatagcacatttgccctatatgcccccctccaacgccatgctgaaataaatccccctattgagtcagatttaacaggggccggccgtgccagattccctgactccacgttttctgacgtgccccgttgaggatcgctgataaccagggcgaaacactattaaggaagatatgccatgaacaaaaactacctctttgcccccgcgttactgcttctggcgggtaccttggccggttgctcgaccaatcccaatgtcttgcaaatacacaaagtcaccgcggaaaccattggcctggcctcgaccgacgaactcaccatgggccccgtcaccaaaggcaaggaagacttcctcggcggctcggaactgaccttcaaagccaccaccgccaagggccgcgtcttcaactgctcgaccttcatgaccccggggatcctgctagatccgccgaagtattcgcggcttacttgtactaactgagcgggtggcagcggcttgaagcaaaaggccccgacttgtcggggcctttttgttttgagcgagcagtagattgccagggtttcacacaatcaggtctctgcaggtttttctcaatgccaaaacaagcttgaggaatgcaaaagaaaataagctctacctccgctgttccgatgcccctatccaagtcccgaccgggcttgctctacccggttgggagtctcgtcttatggctttgcccagtctcctttgcactgatccaatcggtcctcatcagtcccaacccctttctctgtgtcgatgttcccattcaggtcgagatagatatgggtgttcggccattttggggtgatgctgacgcaatgatggcgccccttgtcgctccaccaatccaactgcatgaaaaagtcttcgtctggaatataaagccgttatctgatgttccgcctccgggttgcatccgtcctttatatatccggttctgcacgttccagatgtacttcagctcttccttgccattttgggcgtagtgaacagttactgtcggctcaagaatggtctgcccgacaaaaaacaataccggtagtaacggaatgaatagcagccaagcacatccagatcgccccttactcgcatttgtggtcgtcaatcccttctccccagttttctggcggtactgctagtccttcgtccatgaccatcttcgctgttatccctccgttggagtgctggttggcgaccgggcctgcgctgcccggtcgttggttgtcgagattaagcgttcagcgcctgagacttatcgcccaaggtacgcagcagatcgcagccgtcactgagcagcaggccgatggcaaagcggatctgagcgacatcttgaacgccggaagcgcagtcgaggatttccagcagattgcgggcagcgccgatgcgttgttgggcgcaggtgtagagatcggagagcgaggcgttggcgtccaggtagaggacggggtggtcagtgtcgttgcgggtgagtggaacgggattgcagacgtgtgaactagtcatagctacagctccataaagttgagctatcacccatcgccgcgaaacgatttagggtggcagctgtacgcgggttcgcggaccggtttatggcacccggcacacccgaaggtgtcccacgcacagccgccattgcacaatcgccagacgaaaaaaaacgccggcatcatgatgggggcgctatgcgccataaactcggaccgcgacgtccggtcaccgatgggcagtgacgggcaaactataaatgcaaagctttaccacacgcaagcaagagagaagactaaattattccttacccttacaaaaagcgtctgtaattgcctaagattgatagagtgactccctctaactcctgagtaactatggcaaagcattacccacagaaagagagtacacattcaagctaaaaatagagctttaaaacccaactaactttcaaaaaacaacaacacaaaacaaggtttacaccatcaagcatagtatttatgatcaccagcaccgcccccaaaacccgaaaaggactttgacaccatgtggacagtatttttttacagagatatcccttcaaaactagaccaaaaaaatattgcaatcagtgccaccaacattggttggaatgatttcggatacaactacaacgcgctcctaggtataaacataaatgaaacattacacagctttccaattatgctattgccatttaccgaggacactccagaagtagcggtgagcacatggatcaactatttaataggtgccacaaacaaagaacgcccttggaagaaccaaaataaaatattcccaagttacgtcgttgttttttcatccattacagcctaccaaacattagcacgcctcctccctcagaacgaatatgaggaactactaaaaagcattcgagaaatcaatgcaattcttgacacgcaaattatttccccagaaatctataagcgaattattgaatcaccacaattcgtcgctggtattcttcgcaatatcggaccgtacaaatcatttagatttggctacttctctgcaaacagaatgcctccccctgaagatgcacggattccgtttcgcttttctacgaagcttgacggcttctcaaactcacactcaataaatttcacatacaaaaacctagaggttatgtctgatcgcgctcattgcctgatcggtgtaaatggagtaggaaagactagatacatcaataacttgatattgagcattctaaaaaaaataaattccactgccgccgaaggttgcatctcagagttatatggtgcagatgaaaacataatccaaccacttcagatagatgacaccaacaactggactgagctacctccgttcagccgtataaatgtttactccactgacccacacaaccttttaccaagaaaaaccaatttaaaaggatcatttgactataaatatttcgacatgggactagaaggctcagttacactagctcgcttacttggagatatcataagaagcgacgaacttataggaagtgaggatagatttgttttactaaaaaaatcatgcagcaggttatccctacagcccaactcctcataccagtcctgccaggattggaaaatgcctccaagcttgtagacgcaaatgaaaaacactggattccaataggggcaattagaggtggcgaactaagaaaactagagattattggcaatattgactcagacagagacttagcatttcaaatgggtcagtcgctgacaacgcctcttagtagcggtcaaaaaatgtacttcaggtttgcgacacactttttgacctctgcaagtaaaggaatgttagttttcatagatgagcctgaaacacatctccatccaaacctagtcaccgagttcatgaacttactatatttagttcttgaagcaacatcttcagcagcgattattgcgacacactccgcgtatgtcgtaagagaggctccctctcattgcgttcacgtaattcaaagtgataacacgcaaaacgtaacggtaagcaatgtttatttaaacactctaggggctagcgtaagcgcactttctaactcagtatttggagacagcctggttcaatcatttacagacaaaattgcagcgcagattgctcaatccgagaatagcctagaagcaataatagaacgttacaaaccaatcttgagtatggacatgcttgtaaaaatccgagaactgatgaagggttaaggacttccaccatgagatctctcacatacaaatttatttacgacagaacaatcctagagctggtaatagcacactacaccgcgcttacagacataaaaacaaccataaaagactcatatcgaaaatacgttttaaaaaaagcgtcaccatcaataccaccattagcagtatctcctctacagaggcacgcattagaacttgcctatacaaacaagtccgaagcagcaggacttggttggttgaacagcatttatatcaatggccttggaagttgtccattttgtggcggcgacggagctagaaccattgaacactaccttccacagacatcatatccagaattttcgatattcagcttaaatctgatgccatcttgtggagactgcaatagaaaaagaaatgcttccaacgcacacggagcaaagatcaagttattacacccatattttgatcgcagccttttagataaaatcagtttatatacctccattgacttaaagtttggaatacccagcttcgccatcacttatgatcgaaatcagtttgaggaagagtatcaggcaaggatagatcaccatattgacacctcgatcgacgatactgcatttttcaatcggacttgggcgtcactggaggctttaaaaatccacgctgaaaaatgcaactctgtacaagaactaaaatccaaaatacttgatgagcaaatctatgtttgcgaagccacaggagatctaaactcttggcatcacgctctttgcaaaggaataatgagattaaatgacgacgagattaatgaaatattcaaaaatagcttcggcagaagagtcacacaacaaaaaaacgtgtaaccactgactattcgccagctcatataagcaacaatagtaggcacctgcctaacctactagccttgttgactcatgttgctggcgaacccttacctctattcaatttagcaaccagatagtcacttaaaaactacagatcaaaagttcgccggagtgttggcactaataatctccgcctcatccgccccaatattccgaaacttatgcggcaaggtcgtcggaaaataatatccatcccccgggttcaacacgctcacctgcccgtccaccgtcagttccacggtgccacgggtgacaaggccgcactcctccccctcgctgtgcacgatcggctcgtcgccggagctggcgccgggggcgtattgttcgcgcagaaagcgcatctggcgggttggcagggcggcgccgatcagcagcaggcgggcgccgtcgcggccgaggtcgggttgttcgttggcgcggaagacgtattggtgttcgcgcgggggctggtcgaaggtgaagaagtcggccagggacatggggatgccttcgagcagctttttcagggagctgacggaggggctgacgcggttctgttcgatcagggagatggtggcgttggtcacgccgctgcgccgggccagctcgcgctgggacagtttgtagctttcgcgaacgagtttgagtcgagtgcccgtgtccatagcagccttgtgtgaggtgtacgtgagggtgttgcgcgttggagtgcggccggtgacttttagttgcgaagttcgccgatccagtggccccggaacctgaaaggcggctattaaatcacgtttgtgggtggagctgtagcggtgggcgacgcgggtgaccggccttgccgtgggcggtgccaggcgttgaaaaccggcggtgttttttccggcgctggaagggcctgcggcccttatcgcagcctgcggcagcggctacaggtgaagcggttgcggcggcgaattcggctggaaaaaagcccgcgcgagcgcgggcaaacgcaggaacagggtcgcgatcagataccgaagcggtcacgcagcgcgtagtacgccgcgcccatggcggtcagcggggcctggaaggtgcggccgccgatcatcggcatgtgcggcagcgaggcgaaggcgtcgaagcgttcggcgtcgccgcggatcatttccgcgatcagcttgccggccaaatgcgagcaggtgacgccgtggccgctgtagccttgcatgtagtaggcgttcttttcgatacggccgaattgcggcatgcgcgacatggtcagcaggaagttgccggtccagcggtagtcaatcttcacgtccttgagctgggggaaggtcttgaggatcttcggccggatcagttgctcgatgtcgttcggctcgcgggcgccgtagaccacgccgccgccgtacagcaggcggttgtcggcggtgaggcggtagtagtccagcaggtagttgcagtcttcgacgcagtagttgttgcggatcaggctacgggcgattttttccgacagcggttcggtgaccacgatctgcgaaccgcacggcatgctcttgcgggtcacccgtgggtcgaggtcctgctgcaggtaggcgttgccggcgatcagcaggtacttggcgcgcaccacgcccttggcggtgcgcacgatgttcggttcgccgtaggtgatttccagcgccgccgactgctcgaagatcttgccgcccaggccgatgatggcgctggcttcgcccagggccaggttcagcgggtggatgtgcccgccctgcatgtccagcaggccgccgacgtaggcgtcggaaccgacttcccgggcgatctgtgcctggtccagcagcttcaggttgttgttgccgtagcgctcccagctggccttctgttcggccaggcccttgagctgcttcttgttcatggcggcgaagatcccgcccgggcggtagtcgcactggatgtcgtagtgctggatgcgctggcgaatgatgtcggcgccttcgaagatcatgctgcccagcacttcggcgcttttttcgccgtagcgcgactcgatcacatcgacatcgcggctgtaggaattgaccagttgcccgccgttgcgcccgctggcgccgaagccgaccttggccgcttcgagcacggtgacgctgtagcccgcctcggcgaggaacagcgccgaggacaggccggtgtagccggcgccgatcacacagacgtcgcagtccagctgttcttccagcaccggaaagtcgctggtcgggttgcgggtcgcggcgtagtagctgtttacgtaggtttgcattatcgaattccccagcaggtgcgggtcgtagcccgccccgccgttgttataggtagtcgtcttaacgacaactgtctgcgcgtcgatcatgctgcgttaaaaacaggctcggaatgctcatgtaggcccctacactccgcttcctcgcctgtttttgccttgcctgatcgccgctcgacgagttttcgtaaagcgcctagagcttgatccaggtcgctttcagctcggtgtacttgtcgaaggcatgcagcgatttgtcgcgaccattgcccgactgtttgaagccgccgaacggcgcggtcatgtcgccgccgtcgtactggttgacccacacgctgccggcgcgcaagccacgggcgaagcggtgggcgcggctgaggttgctggtccagaccccggcggcgaggccgaagatgctgtcgttggcgatcgtcagcgcctcttcctcggtgtcgaagctgatcaccgacagcaccgggccgaagatctcttcgcgggcgatggtcatggcattggtcacgccgtcgaaaatcgtcggctccacatacaggccgccagtgctttccaacgtccgcacgccgccggccagcagttgaccgccctgctccttgccgatgccgatgtagcgcagcacgttgtccagctgacgttgatccaccagcgcgccgacgcgggtcgcagggtccagggcatgcccgggtttccaggccttgagggcctccaccagcagcggaatgaattgctcgcggatcgagcgctccaccagcaggcgcgagccggcggtgcagacttcgccctggttgaaggcgatggcgctggccgccgcttctgccgcggcgcgcaggtccggcgcatcggcgaacaccacgttggggctcttgccgcccgcctccagccacacgcgcttcatgttgctctgcccggaatacaccagcagttgcttgcccaccgcggtggaaccggtgaacgccagcacatccacgtccatatgcagggccagggccttgcccacggtgtggccgtagcccggcagcacgttgaacacgcccttggggatgccggcatccagcgccagctgggcgatgcggatcgcggtcagcggcgacttttccgaaggcttgaggatgaacgagttgcccgccgccagggccggggcgaatttccagctggccatgatcagcgggaagttccacggcacgatggccgccaccacgcccgaggcttcgcgagtcaccaggcccagttgatcgtggggcgtggccgcgacttcgtcgtagatcttgtcgatggcctcggcgttccagcggatcgcgttggcggtggccggcacgtcgatgctcagggaatcgccgatgggcttgcccatgtccagggtttccaggagcgccagttcttcctggtgctcgaggatcaaatcggcgaagcggatcagcacgcgcttgcgctcggccggagccttgcgcgaccacacaccggactcgaacgcctggcgtgccacctgcaccgcccggttggcgtcggcctcgtcggtgctggcgacgttggccaaaaagcgcccgtccaccgggctgatgcactcgaaggtggccgcgctggtggcgtggcaatactggccgtcgataaaggcgcgaccttcgagggtcaaggactggaagcgctgctcccagtcgctgcgggatttagtcatggcaaatactcaacgcaggaaaaggaacggccatcagaccgtgtgcaggtaccagttgtattcgaggtcggagatcgaattttcgaactcggccagctcgctttccttacaggcgacgaacacgtcgatgtacatcgggtcgatgtacttggccatcacctcgctgtcgtcgagcacgcgcagggcgtcgcgcaggttgctcggcaggctctgctcgttctgctcgtaggagttgccctccaccggcgcgccgggctcgatcttgttggtcaggccgtggtgaataccagccagtaccgacgccatcagcaggtaggggttggcgtcggcgccggcgacacgatgctcgatgcgcaccgcatccgccgaaccggtcggcacgcgcacggccacggtgcggttatcgatgccccagctcggcgagttcggcacgtagaactgcgcgccgaagcggcggtaggagttgacgttcgggcagaggaacgccatctgcgccggcagggtctccagcacgccgccgatggcgtggcgcagggcgtcgttggtttccgggtcgtcgctggcgaagatgttgttgccttgcttgtcgagaatcgagatgtgcacgtgcaggccgttgccggcctggcccgggtacggcttggccatgaaggtggtgtccatctcatggtcgtaggcaatgttcttcaccaggcgcttgagcagcaccgcgtagtcgcaggctttgatcggatcggagacgtggtgcaggttgacttcgaactgcgccggggcgctttccttgacgatagcgtcggcggggatgccctgctctttcgcgccttcgaggatgtcttgcaggcagtcgacgtattcgtccaggtcgtcgatcaggtagacctgggtcgactgcggacgcttgccggaaattggcgaacgcggcgactgcgggcgaccgttcacgttgtcctggtcgatcaggtagaactccagctcgaaggccgcgcagatggtcaggcccaactgatcaaacttactgacaacttgccgcagcacttcgcgcgggtcggcgaagaacggctggccttcgatctcgtgcatggtcatcagcaattgcgcggtcgggcgcttctgccagggctcgacgctgagggtgccggggatcgggtagcagatgcggtcggcgtcgccgatgtccaggcccaggccggtgctttccacggtggagccgttgatgtccagggcgaacagcgaggccggcaggttgatgcccttctcgtacaccttgtgcagggcggtacgttcgatgcgcttgccgcgcaccacgccgttcatgtctgcaatcagcaggtcgacgtagaggatctcgggatggttcttcaggaaggcgttggcttcgttgagctgaacggcacgcagtgggaccgacatgatgcacctatgtgttaattattatgttcaaagcggtttcgtggcagcagtcaatccgaaaggaaaagtgaagtcaatagcgaacacagggcccacagcgttaaatattttgccctatatggccgctcaagcaggcagcagacccacaaataccgaatatccgacgaactacgtttagaattttttacacgaaagttgttaattaaaatcaacgaggataagctctggaaaaactcgttccagcgtgaatttcgaggtgataaaaatggcattcaagccattgatcggcgttactgcgtgcgtcaaagagatcgggctgcacccctaccacgtcagcggcgacaagtacttgcgtgctgtcagcagcgcggccgagggcctgcccctgatcattccttccctggcggacctcatcgataccgaggctctgctgcagaacctggacggcctgctgttcaccggctcgccatcgaatgtggagcccttccactatcagggcccggccagcgaaccgggcaccgcccacgatccccagcgcgatgccaccaccctgcccctgctgcgcgcggcgattgtcgccggcgtgccggtgctgggcatctgccgcggcttccaggaaatgaacgtggccttcggcggcagcctgcaccagaaggtgcatgagttgccgggctacctcgatcaccgcgaagccgaccacccggacctggccgtgcaatacgcccccgcccatgccgttagggtgcaagcgggcggcgtgttccaggccctggacctgccccaggaattccaggtcaactcgatccacagccagggcatcgaccgcctggcccccggcctgcgcgccgaggcgctggcaccggacgggctgatcgaagccgtgtcggtggaacacagcacggcctttgccctgggcgtgcagtggcatccggaatggcaggtgctgtcgaacccggtctacctgcggatcttccaggccttcggcgatgcctgccggcaacgggcggcgcagcgcaacggccgctgattaaaagcttcacccatgaaattgactgccacgcccccggccggcggcggtgcgcccttgcgcgcccaccctggcctgcggagcggttcaagccacacccagcactacgagaacctgcttttaacaacaagaaccagcgtcaggccgccaggacggcagcgccgaataaacccgccgccgcgggtttgtcatccatctattaagccgggccgttttggcccgacgactgacatctgttgggagttccacatggcaaacgcctccagcacgtacagaaaggctctggaaggtcacccgcaaccgcaaaaggtgctggtgagagtcgaccgcgtgaccaagaagttcgatgaaaccgtggccgtggacgatgtgtccctggacattcaccagggcgagatcttcgccctgctcggtggctcgggttccggcaagtccaccctgctgcgcatgctggcaggcttcgagcggccgacggaggggcgtatctacctggacggcgtggacatcaccgacatgccgccctatgagcggccgatcaacatgatgttccagtcctacgcgctgttcccgcacatgaccgtggcgcagaacatcgccttcggcctcaagcaggaccgcctgccggccagcgaaatcgacgcgcgggtcgaagagatgctgcgcctggtgcacatgacccagtacgccaggcgcaagccgcaccagctgtccggcggccagcgccagcgcgtggccctggcccgctccctggccaagcggccgaagttgctgctgctcgacgaacccatgggcgccctggataaaaagctgcgctcgcagatgcaactggaactggtggagatcatcgagcgggtcggcgtgacctgcgtgatggtgacccacgaccaggaagaagccatgaccatggcccagcgcatcgcgatcatgcacctgggctggatcgcccagatcggcagcccgatcgacatctacgaagcccccgtcagccgcatggtctgcgagttcatcggcaacgtgaacgccttcgacggcaccgtcatcgaagacctggaaggccacgcggtgatccactgcccggagctggaacagcagatctacgtcggccacggcgtcagcacctcggtgcaggacaagtcggtgacctacgccatccgcccggaaaagatgctggtcagcaccagccaaccggagcaccgctacaactggtcccggggcaaggtgcatgacatcgcctacctcggcgggcattcggtgttctacgtcgaactgcccggcggcaagatcgtccagtcgttcatggccaacgccgaacgccgcggcgcgcgtccgacctgggacgaccaggtgtacgtctggtgggaagacgacagcggcgtggtactgcgcgcatgaatacctccagcatgactctcaatcagcgtttgtcccgtgtgctgcccagcggtcgcaagctggtgatcggcattccattcctctggctgttcctgttcttcatgctgccgtttttcctggtgatgaagatcagcttctcggaagcggccctggccattccgccctactcggagatctacagcttcgccgaacagaaattccagctgctgctcaacgtcggcaactacgcgctgctggtgggtgacgagctgtacatctcggcctacctcggctcgctgaaagtcgccctgctcagcaccctgatgtgtctggtgatcggcttccccatggcctacgcaatcaccaaggccaacaaggaaacccagaacgtcttgctgctgctgatcatgatgccgacctggaccgcgatcctgatccgcgtctacgcctggatgggcatcctcagcaacaacggcctgctcaacggtttcctgatgtggagcggcctgacctcggagccgatcgagatcctcaacaccaataccgcggtctatatcggcgtggtctacgcctacctgccgttcatggtgctgccgctgtacgccaacctggtcaagcacgaccagagcctgctggaagcggcgtcggacctgggttcgagcaacttcaacaacttctggaaaatcaccgtgcccttggccaagaacggcatcattgccggttgcatgttggtgttcattccggtggtcggcgagttcgtgatcccggaactgctcggcggtccggaaaccctgatgatcggccgcgtgctgtggcaggagttcttcaacaaccgtgactggccggtagcctccgccctggcagtggtgatgctggcgatcctgattattccgatcctgctgttcaaccgcagccaggccaaagagatggagggacgggcatgaaacgttgcggattttccagcctgatgctggtgctcggcctggtgttcatttacctgccgatgctgatcctggtgatctactcgttcaacgcttccaagctggtgacggtctggggcggctggtcggtgaaatggtacgtcggcctgctggataaccagcagttgatgggctcggtggtgcgctccctggagatcgcctgctacaccgcgatcgccgcggtggccctgggcaccctggcggcttttgtgctgacccgggtcacccgcttcaagggccgcaccctgttcggcggcctggtcaccgcgccgctggtgatgccggaagtgatcactggcctgtcgctgttgctgctgttcgtggccatggcgcaactgatcggctggccgcaggagcgtggcatcgtcaccatctggatcgcccacaccacgttctgcgcggcctatgtggcggtggtggtgtcggcgcgtctgcgtgagctggacctgtccatcgaagaggcggccatggacctcggcgcgcggccgtggaaggtgttcttcctgatcaccatcccgatgatcgccccatcactggcggccggcggcatgatgtccttcgccctgtccctggacgacctggtgctggcgagcttcgtctccggcccgggttccaccaccttgccgatggaagtgttttcggcggtgcgcctcggggtgaagccagagatcaacgccgtggccagcctgatcttgctggcggtatcgctggtgactttcctggtctggtacttcggccgccgcgccgaagcggcccgcaagcgggcgatccaggaagccatggactacaccgccaacgaatcctggcagccagcggccgccagcaaacctgccgcaccagcgcctgcgacggcctaggccatcgcgttcacgacacacggcagcgcctggatcgcgaacacgctcgctcctacagacatgcaccgtccctgtaggagccagcttgctggcgatggcgcccaccctgacacaccgcattgcgaatgcagcaattctgcacaataagaaatggagttgtagtgatgaaaatgcttggcaggactctgctaacactgtccttgatgggcgcgatggtgaccggcgctcaagccagcgacaaggagctgcgggtctacaactggtcggactatatcgccccggacaccctgaagaagttcgaggccgagaccggcatccacgtcatctacgatgtcttcgacagcaacgaaaccctggaagcgcgcctgctcaccggcaagtccggctatgacatcgtggtcccgtccaacagctttttggccaagcagatcaaggccggggtctaccaggcactggacaagtcgcggctgccgaactggaagaacctcaacccggtgctgttgcagaacgccgccgccagcgacccggacaacgcccacgccttcccgtacatgtggggctcgatcggcatcggctacaacccggacaaggtcaaggcggtgctcggtagcgatgcgccgaccaactcctgggacctgctgttcaagccgcagaacgccgagaagctcaaggcctgcggcatcagcttcctcgactcgccgacggaaatgctccccgccgccctgcactacctgggctacccggtgaccagcaaggacaaggcgcagatcctcgaggccgaggcgctgttcatgaaaatccgtccttcggtgacctacttccattcctccaagtacatctccgacctggccaacggcaatatctgcgtggccgtgggttactccggcgacgtgctgcaggcccgctctcgcgccgaagaggccggcaacaaggagaaggtcgccttcagcattcccaaggaaggcgccggcagcttctacgacatgatggccatgcccaaggacgcggccaacgtcgacaacgcctacctgttcatgaacttcctgatgcgcccggacatcatcgccgaggtcaccaacagcctcggctacagcaacgccaacgccgccgccacgccgctggtggacgaagccatccgcaatgacccggcctcgtacccgccgcaggccgtgctcgccaccctgtacgcggtgcccgaccagccgatcgccatccagcgcgtgatgaaccgcggctggacgcggatcaagctcggcaaatgacagcccgcgcccgctcggtaatcgcggcgggcgccgcagccctcttccgttcagtcgcgccttaccaccgcgacacccctgcgaacgggctcgcctggctccctcggttcaggtgactccttggcgccctcctcgggcgccttttttgctttcaaccccccacacaaaaccctgtagccgctgccgcaggctgcgatcgccccaaaggggcgcaacgacctcaagacccatgaaggccctgcgggccttatcgcagcctcgcaggctcggcagcggctacagggccagtgccaagcttcgtgtagccgctgccgcaggctgcgatcgcctcaaaggggcgcggcgatctcaagccccatgaaggccctgcgggccttgtcgcagcctcgcgggctcggcagcggctacaggatcggggcatggcttcatgtagccgctgccgcaggctgcgatcggcccgaagggacgcaacgatctcaagacccatgaaggccctgcgggccttatcgcagcctcgcaggctcggcagcggctacaggatcgctgccaggcttcatgtagccgctgccgcaggctgcgatcggcccgaagggacgcaacgatctcaagacccatgaaggccctgcgggccttgtcgcagcctcgcgagctcggcagcggctacaggatcggggcatggcttcatgtagccgctgccgcaggctgcgatcggcccgaaggggcgcaacaatctcaagacccctgaaggccctgcgggccttatcgcagcctcgcgggctcggcagcggctacagggtcgctgcatcatccggcgagtcccccaaccacaaacaatgctattttttgccgctcgcggcgcaaccaggcgctgccacttctacagggaacgtatcgatgcagaccgccgtccagccttgtccattgcccagcccgtccagcattgccaggctggccgtcggggcgagcttcatcgattgtcgccaggcgttggccaacgaccccgagcgcacagccatgcgccacctgctcaacctgatgagccagaccccggcctggatcgaccggatgatgggcctgcgcaaccgcgtggtgcagttgttcggcctcaaggacctcgggcgcctgacacgcatcgacctggccagggcggacgaggattaccggccggacgaccgggtcggcatcttcaccctggttgcccaggcccccgacgaggtactggtggtggaccgcgaccagcacctggacgtgtacctgtccctcaatcgcctgccgctgaccgccgaaggccaacgcccggtggtgctgtccaccgtggtccacccacacaacctgctggggcgcctgtacatgctgccggtggcaccgttccatcggctcatcgcgcccatgaccctggccaacatcaatcgccgctgagccgccacattcaaggacactgccatgcagacacccgagttcgacgttgttgtagtaggcctgggcgccatgggcgcagcgaccctgtaccagttggccaagcgtggcgtgaaggtggccggcatcgaccgttttgccccaccccacgaccagggttcgagccatggcgacacccgcatcacccgccaggccgtgggcgaaggcgccgtctatgtgccgctggcgatccgcgcgcagcagatctggcgcgagctggaagcgcagcaggatgcgccgttgttcgagcaatgcggggtgctggtgatgacgtccagcgctaccccgagcggccaggacggcgcgccggacttcaccgaaaacaccctggccctggcccgccaattcggcatcgagcatgaagtgctggatgccgcgcagctccgccagcgcttcccgcagttcgcgccgatccacgacagcgccctgggttacttcgagcccggcggcggttatgtgcggccggagcgttgcatcgacgcgcagctggccctggcccgccagttgggcgcgaccctgatcaccggcgagacggtgctggatatcgacagcaccccggaccgggtgcagatcacctgccagcaccggcgcatcagcgcaaccaaggtggtggtctgtgccggcatgtggtccagccaattgctcggcgcgccgttcgacaagttgctgcgggtgtgccggcagaccttgtactggtaccagttggcggaaccgctgatcttccccgaacactcgccgagttttatcgtccacggcgccagcgacgagcagacctgctacggcttcccgccgatacccggcgaaggcagcatgaagatcgccaccgagcagtaccgcgagacttcgacgccagacaacctggaccgccaggtcagcgcggcgcagagcgaggcgatgtaccgcgacctggtgctggccactatcgccggggtcacgccgcgactggtgaagtccgcggtctgcgcctacaccgtgaccccggactcgcacttcatcatcgacgagcacccgcgcctggccaacgtcatggtggtcagcgcctgttccggtcacggcttcaagcactcggcggcgattggcgaagccctggcccagcggctggtggacggacgcagcgagatcgatttgagtgcattttccctggcgcgcttcggccattgagcggtgcctggacgcccctggatggggcgttttccgggaagaaacgattcagtgacgtttttccttctgtgggtgccgctttcaaccttgccccttcgttcagtctctacgattctgtagagacccccgcggggcggcaccagaccgcccagggcaaaacaacaggagcgccccatgaagagcgtcgctgaagtactgaagttgaaggccaaacacaaccagcaagtgcacaccatcgcgccccaccagatggtgctcgaagcactgatgctgatggccgagaagaacgtcggcgccctgcccgtgatgcagaacggcgaagtggtcggggtgatcagcgaacgcgactacgcgcgcaaactggtgctgcacggccgctcctcggtgggcacgccggtcagcgcgatcatgagttcgccggtgatcaccgtggactcgcaccagagcgtggaaacctgcatgggcatcatgaccgacagccacctgcggcacctgccggtggtggaagacggccagttgctgggcctgctgtcgatcggcgacctggtcaaggaagccatcgccgaacaggccaacctgatccgccagctggaacagtacattcgcggcgagtagcctcctccctggtagccgcctttgggcggctacattcccccgcacacctatcttctgtaggagcgaagcacacagtgtgtagccccttaccaggcgccgtttaacccgcggtgaagaactgccgcccatcacgcttgagcaaatccaaaagcagctgggccgccggcgacaggtagccttcggtccgcaccagtaccacgatgctgcgatgcatgcgggtttgcgccagcggcacttccctcaggtgggcgatacccttgaagtcgtccagggtttcccgggccaggaagctcagcagaccggtcttggcgatcagccgcggcagcagggaaatggtgttggtctcgatctgcaccgacggcaatggcagctggtggctctggaacacattgtcgatccagcggcgggccgagactccggttcccggcagtacccaacggtagtcacacaggtcttgcaggcgcatcggcgtgtcgaacaccggatggtcgcggctggccaccaccacggcctggtcttcgaacagagtgtgatggctcaggtgcgggtcaccctcggacagcggacagatcaccatgtccaggcgccccgaacgcagggattcgcggagaacgtcgtcctggccgatcaccaggttcagggtgatgtccggggcgcgctccagcagggtcgcggtcatctgcggcagcaagtgctcggccatgctggcggcacagcccaggcggatattgccgagcacgccgctggcaaaatcgcgcacctcgcgatgggtctcggcgatgttctgttgcaactgccgcgcgcgctgttgcagcaactggcccaccgccgtcagcttgattcgccgcccgtcacgctcgaacagcttggtgccgaaggactcctccaggcgctggatgctcttggtcagcgccggctggctgcgattgagcttctgcgccgcgcgcccgaggtggccgagttcggcgatggtttcgaaataggtcaggtcgcgcaggtccatgatcgataaaccagagttattgattgatcacaattagaaactggacttgatcaattgcgctatcaataatttgctccgaagcgctggtagcaacggtcccgcaacaggaacggccagcgcgctggagaatgcccttgcctcgcccctcgcctttgtccctgtccgcctggccccttgccctgcaatggctggcgctgctgatcctcgccggcagcgccgggcaactgctgaaccacttcgaggtgcccgccgggcagtttctcgggccgatgctggtggccatcggtttcggcgtcagcggcgccagcatccgcgtgccgcgccaggcctttcgcctcggccagggctcggtcggggtcctggccgcccactccatgaccatggccgtgctggcctcgatggcccagtcctggcacgtgatgctattcgccaccttgctcaccgtctgcctcagtgccctggtcggcctggcgctggtgcgcctcggcggcctgccacccagcaccgcggcctggggcaccgcgccgggggcggcctcggccatggtcgcgatggccgacgacttcggcgccgactcgcgggtggtggccaccatgcagtacgtgcgagtggtgtgcgtggtgatgatcggcgccctggccggccactggatcggcgtgccggccggcggcagccaggcccacagcaccgaggtggtgctgcagaccttcaccctgctcaacctcggcctgaccctgggcatcatcgtgctcggcgtgctgctcggctcacgggtgccggccggggccctgctggtgccgctgctgatcggcggcgccttgcagatctccggactgctgcacatcaccctgcccggctggctgctggccctggcctatggcgccatcggctgctacatcggcctgcgcttcgaccggccgaccgtgcgctacgtctggacccgcctaccggcgatgatcttcggcgcggtgctgctgatcgccctctgcgcgctgtcggcctggctgctggcgcactggctggacaaggatttcctctcggtctacctcgccaccagccccggcggcctggacgccatgacgatcatcgcggtggacacccactccgacgtcggcctggtgctggccatgcagaccctgcggctgttcgcggtgatcgtcagcggcgcttttttcgcccggctgatcatcaagtgggcgcgctgaaccctggggccgcgcgtctttaaacactctgaaatagtaaatccaagcgccatccgcccttccctggccccgccgccaggcgcctgaatacaggcttcaagccgccgccctgcagcgccccgggccgtttcagcagcggcccggaagcttatttcccgcgcgaataagaaacgtcttgccgccggctgttgttaccatggcgcacatttgcgtgaagatttaatgactggcaggtttttcgtgaatttcatccggcgtgttttccatcatcccctggcccccctcggcgcactgctgagcctggtgctgctcgtgcccctggtggcgcgcgcgctgctcggctggtccgaccccctgggctatctctccgacctgggcaccgcgggcctgttgaccctgctgctgtaccgccggccctggtggctggccctgccggtgctgctggtgtggagcctgctgagcatcgccagcgccgagctggtcagcgccgtgggccgcctgcccaatgcctccgacctgcattacctgttcgacccgcagttcgtcagcaactccaccggcggcggcctggcccatccctggctggcggcggcgctgctgtccgggctggcgttgtggctgggcgtgcaatgggccgcccgcggcacccgcgccccgcgcttgccgcgccatgcctggaccgccccggcgctgctgtggctggcccacggcggcgtgcaatacctgaaccccagcgaagccgatcaatggcgcctgttcaacctgccgcaccagttgctcgcggccgccgccggccagggccaggtacagctggaacaatggctggaaggcgatgtgcccgaactgccggtgcagatggccggcctgacccagctcgacctcgacggcgagccgttgctggccgccccgggccaggcgcgcaacgtgctggtgatcgccctggaaggcattcccggggcctatatcaagaccaaccgcgaggccctgcacagccgctaccaggacaacctgatgcccaagctcagcgcctgggccgaacgcggcatgaacaccccggactacgtactgcacagccaccagaccatccgcggcctgtacgccatgctctgcggcgactacgacaagctcgacaacggtacgcccaagggcatcgagttgctgacccaaagccagcgcaaccaggcctgcctgccggcccagctgcgcaagcagggtttcaatacccattacctgcaaggcgccggcctgcgcttcatggccaaagacaagatcatgccgcacatcggcttcgactcgacccacggcctggagtggttcagcaacgccaactacctggacttcccctggggcaaggacgacaaggctttcttcgaaggcgcgctggactatgtcggccagctgaaaaagcagaagcagccgtggatgctcaccctgctgaccgtcggcacccaccagccctactccgccccggaggactacctcaaccgcttcgacacacccaagcaggccgcggtggcctacctggacgatgccatcggcgagttcatggaccagctggagcgccagggcgtgctcaaggacaccctggtggtgatcacctcggacgagtcccacggcatcgatggcgtgcgcctggcctcgtcgtggggcttcaacctgatgctcgccccggagcaggcgcagttacccaaactcaagtccgggacctacggccatgtcgacctgagcgcctcggtgctcgactacttcggcttccaggtaccggacagtctcagcggccgctcgctatttcgcgactacgccctgggccgggagatcatgtcctacaccaacggcaagctgcgttatcacgatggccagggcaccctgaccgaatgcgatttccagcagcgctgccgctactacgcaagcaccggtttcatcgccgacagcgccaccttcaagggccagtacggcggcctgcgggcgcgccagatcagcgcccgggccgaaggcctggaccgtaccctgctgcaatcgccgctgaacctgcactaccagttcggcagcccggcgatcatcccgctgcaggcgcagatcaaggatgactgggccgacaacctgatcggcgcgcagtacctggaaatgcccaagggctcgctgacccgcgtgcgcttcaccgtgcgttcggccgacccgcagcagaacgcctacatcctgctcaagggcaaggagagcgagcaggacgtgcccctgggcctgccggaagagatgctggtcacccccgaccagccgctggaaatggacttcagcttcgccaacccggaatcgcgcaaggccttctccttccacctgctgggctacggcctgggcgcggtggaagtcagtgacttcagcgtgatcaccgaactgccggggcaagagcaagacagcgaagaaccccaggacgacaacccgcacgcctcctgaatcgcctccccgggagctggacggcagcacgaccgcccagctcccgcgcccttgtctaaactcctcgtcaggcacaaggtatggcctcgctgcggtccgcagcgccaccgccggagtacgaggacgcacatgaccgacaccctggacacccctctggagcagctgcagcgactgatggccgagcgccccttcatggtcctcacgggcgccggcatcagcaccccttcggggattcccgactaccgcgacaacgacggcgtgcggcgcggccagcaaccgatgatgtaccaggagttcctggccgaacccaaggcccggcgccgctactgggcgcgggccatgctcggctggccgcggatccgccaggcccggccgaacgcagcccatgaggccctggcgcatttacaggcgcggcagaaaatcgccggcttgatcacccagaacgtcgacaccctgcacgaccaggccggcagccgcgatgtgatcgaactgcacggcaacctgcaccgggtggtctgcctggattgccgccaacgcagcgatcggcaggcgatccagcaattgctggaactgcacaacccctacctggccggcgtcgacgcggtgcaggcgcccgacggcgacaccctgctcgacccggtgttcgaagaacgtttccaggtgccccgctgccctcattgcgctggcgagcggctgaaaccggatgtggtgttcttcggcgaaaacgtggcccaggccaccgcggccaaggccctgcacagcatcgagcaggccgccggcctgctggtggtgggttcgtcgctgatggcctattcggcctttcgcctgtgcaaggtcatggccgaccagggcaagccgctgatcgccatcaacttcggcaagacccgcgccgacgagctgctgaacctgaagatcaccgcctcctgcgagcagctgttgccgctgctggccgagcgcctgacctcctaggcaatccccgacaggcgctcggccagaccggccccgcgcaaaatgtcgaacagcgcctgggccgcgctcgacagttcatgcccggggttggtcagcacgccgatggcgcgttccaccaccgggtcgcgcagggtgatgcaacgcgcgcccagctcgcgcatctgtccggcgcacagggccggcaccgcgctcacaccgagaccgctggcgaccatgcgccccaccgtcgccagttgatggctttcgaattccaccggcagtttcatgtcccgcgccagcaaatgctcttcaagcatcacccgcaccgtggacggccgttgcagggtaatgaagggctgttccagcagcgattgccagtcgatgtccttcaggtcggccaggggcgaatcgctgggcaccacggcgacgaagcggtcgatgtacagcggggtgaattgcagcgacgcgctttgctgcggctcgaaggccacccccaattccacctggcggtcgcggaccatctccagcacctgctcattgatcacgtcgttgaccgtgacgttgacctgcgggtaacgcgcgcgaaaggtcttgaggatcggcggcagcaggttgccggcaaaggacggcatggccgccagggtcacccgcccgcgctgcagggtgaagcgctggcgcagttcgtcctcggcgttgtcccagtcggcgatcaggcgccgcgccaggggcaccagcgcctcgccttccggggtcagggcgacattgcgtgtgttgcggctgaacaggcgcccgccgaggccgtcctccagggccttgatagtcaggctcagggccgactgcgacaggtgcaggcgctcgcaggccacggcgaaactcaggctctgggccaccgccagaaaggcgcggatctgtttgacggtcatgctctgccctcgggatagactgttgagttttatctatcaatcaaccttaaaaatcaacttaacaaatcaatcccctggcgcaacactgcggctcactctcttcatacggccagccagccggctggcaacgcaaataccaataacaagaggatgtgcagatggcaggtttcgacaagcgcgtggcgtcctatgaggaagccctcgaaggtctcaaggacggcatgaccgtgatctccggcggcttcggcctgtgcggcattccggaaaacctgatcgccgagatcaagcgtcgcggcacccgcgacctgaccgtggtctccaacaactgcggtgtcgacggcttcggcctcggcgtgctcctggaagaccggcagatcagcaaggtggtggcctcctacgtcggtgaaaacgccctgttcgagaagcagctgctgagcggcgaaatcgaagtggtgctgaccccgcaaggcaccctggccgaaaaaatgcgtgccggcggcgctggcatcccggcctttttcaccgccaccggcgtcggcacccccgtcgccgacggcaaggaaacccgtgaattcaacggccgcgcctacctgatggaagagtccatcaccggcgacttcgccatcgtcaaaggctggaaagccgaccacttcggcaacgtggtctaccgccacaccgcgcagaacttcaacccgctggccgccaccgccggcaagatcaccgtggtcgaggtcgaagagatcgtcgagccgggcgagctggacccgacgcagatccacacccccggcatctacgtcgaccggatcatttgcggcacgttcgaaaaacgcatcgaacagcgcaccgtgcgcaagtaatcgcccgcccaacgactgacggagaataaaaaatggctcttacccgcgaacaaatggctcaacgcgtcgcccgcgaactgcaggacggtttctacgtgaacctcggcatcggcatcccgaccctggtggccaactacatccccgacggcatggaagtgatgctgcaatcggaaaacggcctgctcggcatgggcgccttccccaccgacgacgaagtcgatgccgacatgatcaacgccggcaaacagaccgtcaccgcgcgcatcggcgcgtcgattttctcttccgccgaatccttcgcgatgatccgtggcggccatatcgacctcaccgtgctcggcgccttcgaggtcgacgtgcagggcaacatcgcctcgtggatgatccccggcaaactggtcaagggcatgggcggcgccatggacctggtggccggcgcggacaacatcatcgtcaccatgacccacgcctcgaaagacggcgagtcgaaactgttgtcgcgctgcagcctgccgctgaccggcgccaactgcatcaagcgcgtgctgaccgacctggcttacctggagatcgagaacggcgcgttcatcctcaaggagcgcgccccgggcgtgagcgtcgaggaaatcgtcggcaagaccgccggcaagctgatcgtaccggcccacgtgcctgaaatgcagttcgcctgaggagcaaccagaccatgcaagacgtcgtaatcgttgccgccacccgcaccgcggtcggcagtttccagggttcgctggcaaccatccctgcggtcgatctcggcgctgcggtgatccgccagctgctggcccagaccggcctggacggtgcccaggtcgatgaagtgatcatgggccaggtgctcaccgccggcgccgggcagaacccggcgcgccaagccgcgatcaaggccggcctgccccacgcgtgccggcgctgaccctgaacaaggtctgcggctccggcctcaaggccctgcacctgggcgcccaggcgatccgctgcggcgacgccgaggtgatcatcgccggcggccaggagaacatgagcctggccaactatgtgctgcccggtgcccgtaccggcctgcgcatgggccacagccagatcgtcgacagcatgatcagcgacggcctgtgggatgccttcaacgactaccacatgggcatcaccgccgagaacctggtggacaaatacgccatcagccgcgaagcccaggatgccttcgccgccgcctcgcaacagaaggccgtggccgccatcgagggcggacgtttcgtcgatgagatcaccccgatcctgattccccagcgcaagggcgagcccgtggccttcgccaccgacgagcagccgcgcgccggcaccaccgccgaatccctgggcaagctcaagccagccttcaagaaagacggcacggtcaccgccggcaacgcctcgtcgctgaacgacggcgccgccgcggtgatcctgatgagcgccgccaaggcccgggccctgggcctgccggtgctggcgaagatcgccgcctacgccaacgctggggtcgacccggcgatcatgggcatcggcccggtgtcggccacccgccgctgcctggacaaggccggctggtccctggagcagctggacctgatcgaagccaacgaagccttcgccgcgcaatcgctttcggtgggcaaggaactgggttgggacgcgagcaaggtcaacgtcaacggcggcgccatcgccctcggccacccgatcggcgcctcgggctgccgggtgctggtgaccctgctgcacgaaatgctcaagcgcgatgccaagaaaggcctggccaccctgtgcatcggtggcggccagggcgtggcgctggccatcgaacgctaacgcttaccgcgcaccacggccggccctcggacccacgacatccggcggctggccagcaatacgcccggcgcaccccatggtgcgccgggttcattttgcggcccggcagacgccggacagaggccgctggcagccacccgcccgtcagctacattcaactcatgcggctggcgagactcgttttccacgccttcctgcccactgactcacggctgaaacagtccaggccgatgcgtggagccttatccgccgaagccggatcacagcgctcaagccccatgggcagagcccgggacaccacccagcccttcgcctgcttcatcgacccgataacgaggagcggaacatgcgcccgatcagatgcctgctctacaccggcttttgcatagtgctggcggggctggtcagcctccaggccagtgccggcccctccttcgacgcggacagaaaaggactcgagaagctctcgaccaacgccggcgccgagctgcaccgaggcttgcagaaatcccacgaaatgctgatgtacctcgaactgagggacaccttgcatgccaccgaggccaaggcagcggccctggagcacttcaacgagtcggtcgccctgtacaagaaagtcactgcaagcgcccccgagcagaagatcctctaccagccccgggatgacagtgaaaaagacgccatcagcgccttccagaagcgcttgcaagagttggatatcgcggtgcccgacaccgagaagcagctggccaacctcgccgtcactgtggtgacccgacatatccatgtgctggaaaggtccagcttcaaggcgaccaaggccgactacccatccttgcgcaaggtcctgcgctcgcaggccctgttgctcgacctgggcatcctcagctcgattgtctggagcctgtcggtcgaccaacccgctggggccagctaagtcactgatcaaggatcgaatcatgaaaaaaaggattgcttctgtacttgtcggcatctttctcctgagcgtctgcacgctactggccctctattggcccactggcatagaaacaaacatacgcaacgaaataggtaaatcggccctgcatctgttggtggtatcggtgatcggcacgattatttcgctgctggtctttgaatatcagcgagaacgacaaactatcgatagaaatgcagagcaggcccgtcaagccagcgaaaaaaagcgtgaccagcaacaaaagcacttcgagtaccgagagtcgcttttgatctccgcgctttcccgaaccgcgaacgcctacagcagggccaaaaaagcccggcgagtgaccagggcgcatatgacgctcacaggaacgacacgccagctttcgctgaaaacctgattgaaaaactgaacaccatggatagctatctgggggagctgataacggaatatgaagactctcgacagaaattcatcggaacgctcccccccctccctcttagtgactttccgttactggataactacgtcaggccagcgaacagcagcttcatgtccgcaatggttacgccgtacagcgagatccaggccaccattcgtagcgacctgcttcatcccaacctgccctaagcgggccgaccacaagcctttcactccgttctcggcttgcccatcagcaacagcaacgacaagccggcaaaccccgccccggcgtagaacgtcagcgcggcgccatgaacctgccacagccagccggcgatcacgctggccagcagcagggccattccgctcaacaggttgaacacgccaaaggccgtgcccttgaggtcggccggcgtggtgtcggccaccagggtggcgaggatgccctggctgaagcccatgtgcaggccccacagggcgacgccgagcagcaccagcggcaccgactcggcataggccagcaccaggtcggcgaggatcagcaacaacaggccgacgctgagcaaggcgctgcggttgatgcggtccgaccatttgccgaccggataggccgagaccatgtagaacccggccatgaccaccatcaccagtggcacccaggcggcggagaagcccagttgctgggcccgcaacaccaggaacgcctcactgaaacgggccagggtgaaggccgcgccgatggccaccacccaccagtaatgccgggaaaaccgccgcagcgaggccagccgcaatggcgactggaagtgccggctgccgggggcgtgctcgggttcgcggatggcgaagaccaacagggccacggccagcgccgcggggatcaccgccagccacaggacctgggcgatatcgttggccagccacagcatcaggccgatggccaggatcgggccgaggaacgcccccacggtgtccagcgactggcgcaggccaaaacaggcgccgcgaatttctgccggggccacatccgccaccagggcatcccgtggcgcgccgcgaatgcccttgccgatgcggtccagcaggcacgcgctgaacaccagttccgccgaactcgccagggggaacagcggcttggtcagcgccgccaggccgtaacccaatagcagcagttccttgcgccggccgatgaagtcgctgagggcgccggaaaagactttcacgatcagcgccgtggcttccgccaccccttcgatgatgccgaccgccagcatgctgatgcccagggtaccgaccatgtacagcggcaacaggctgtgcaccagctcggacgacacgtccatgaacaggctgacgaatcccagcgcccagaccgtgcgcggaatgccgcggctcaggtgtttcccggattcgctcgttacaggtcccgccatgacagacatcccccagggtttacaaaggatccggttgcccaagcctaggccgacaacgacggcaatgcctgtcatggctcccgttgcaatcgacgctcgagggccgcggccagggccgacgcctcctgtttcaaggaggcgcagaaggcctcgacgaaaatcgacgacggccggaactccggacggatcagcatcacccggtacggcaccgacaactgcagcgggcggatcgccaggcccctgcccgcctcctccatggcgctcagcgggttgatgatcgccacccccaactgctggcgcaccatggcgcagaccgaggcggcattggtggtctcgatcaccacccggcggtcgacgccggcctggcgaaaatgctcgtcgagggtctgacgataaatgtccaggcctgacaggttgatgaaatccaccccgcgaaagtcttcgctgtgcagcagcggcttggccagcagcgggtgcccttccggcaggatgcacaccatgtcggcgcagaacagcagctcgccctgggtgccccgtggcaggtgctcgctttcggtcaggcccaggtcgtggcgctgggcgctgagggactcttcgagcaagggcgattcctgggcggtgatgctcaggccgatgccggcgtgttgctcctggaagtgcttgcacacccgcggcagcaaggtctgggagaacagcggcagacaggtcaggctcaattggccgtgctcgaagcggcggatcgattgcgccacgctgttgatccgctccaggccgacataggcccgctccacttcttccagcaacagcatcgcctgggcggtcggcagcaggcggccgccctcgcggtcgaacaggctcagcccggacaggctctccagccgcgccagctcgcggctgaccgtgggttgcgaggtgaacagcaggcgcgcggcgccggtgacgctgccggcctgcatgatggcgcggaacacctcgatatggcgcagggaaatgtccacggcttgctcctcggtttgagacgttgattcacacaagccatatcagaactgaatcgagatacaaagaatagatattttattgaatacgtcgccctcggcatcatgcaggcctctttcctcgccacagacgattgccatggccattcccttttctcccgagcaactgaccgccgccgcccgccagtacggcaccccgttgtggtgctacgacgcgcggaccatcaaggtgcgcatccagcaactgaaggccttcgacgtggtgcgttacgcgcagaaagcctgctccaacctgcaggtgctgcgcctgatccgcgaggccggggtgcgggtggacgcggtgtccctgggggaaatcgagcgggcgttgctggccgggttcagcccggagggcgatccggccggcatcgtcttcacctgcgacctgttcgacaccgccaccctgcaacgggtggtggagctgaacatcgaggtcaacgccggttccatcgacatgctgcgccagcttggcgagaaatccccgggccaccgcgtgtggctgcggatcaacccgggcttcggccacggccatagccgcaagaccaacaccggcggtgaaaacagcaagcacggcatctggcacgagcaggtcggcgaagccctcgcggtgatccgccagtacggcctgaagctggtgggcctccacatgcacatcggttccggcgtggactacgggcacctggagcaggtcggcgcggccatggcggcggcggtcaagtccctggaccacgacatcgaggccttctccatcggcggcggcctgtccaccccgtaccgcgcggacgatgagccggtggacgtgcggcgctatgccaatgcctggcgccaggcccgcgaggaaatcgaagcctggctcggccacggcgtgcgcatggaaatcgaacccgggcgtttcctggtggccgaggccggctgcctggtcagcgaagtgcgggtggtgaaagacgctggcaatcatcacttcgtgctggccgacaccggcttcaacgacttgatgcgcccggccatgtacggcgcctatcacgccatgagcctgatcgacgccaacggccaggcggtgcagcgtccactgcggcccaccgtggtcggcggcccgttgtgcgagtccggcgatatctttacccaggacgacgaaagcctgaccccgcagcggctgccccaggcccgggtcggcgacctgctggtgatccacgacaccggtgcctatggcgccagcatgtcctccaactacaacagccggccgctgctgccggaggtactgttcgaggatggccaggtgaaactgatccgccggcgccagccgctggcggacctgctggaactggagatggggttgtaagggcctgagacgcaacgttacaggtaagcggggggacgatctgcctgcccccccctttccaggtatccccccttgatcgacgccgggacttcgtggccagccgctggagtgctggccacgccaatcaagaaacctgccccgacgccgagtaccgcctggcgctagccctcgaccaccaccaggaactggctgtagcgatcgatgccgtccttggacagttcaagcccggtctcgcccatgcgcgacatccacttgccgttgtcgccacgcagggaaatctgcccgctggcggtgtcgatggcataggagaactggcagtactgatcgatgctgtccttggacagttcaagcccggtcgcccccatccgcgacatgaacttgttggtgtcgccctgcaatgccagcttcttgtcgttgccgatctggatcagggtgaccctgaacttgcagtactggtcgatggcgcccttggacagttcgagccctgtcgcgcccatccgcgacatgtagttgcccgagtcgccgcgtagcgagatgacagtaccgttttcaatcacacgttgaggaagaacgatcatgtttggcactccttgctgattgggtaggttccctggtgtaaccacaggcgcagcaatgccttggcaactcatgaccgtgctcatcccggagggatattaaacgcccctggattgcctgccgcaggcgcagtgtagtcgagcgattgccggctcccgggacgcccgggagacaactggaccagcggttgccgcggccccgccgccctcagatcaaagcgctatgcacggccagatgcagacgccacaaggctataaaaaaccgtggagcgccaaggctccgaagagccaggagtcgagtgcggggacagcttcacagctgggctgtgaagcctgtcgggggggaaggattcagtcttgctgggggctcatgtaccgcgagaaattctcaatgtagtcggtaaggttttcttccatcatcaggcggaattcctcgacgaaataatccaccgcctgctgcttggccgccgccagttcttcggcgttgcggcaaccgcaggcgctgacccaggcggcgaaacgcgagttggcgtacatcagcgaggcactggccttgccgcggctgctgtcgccgatatgggtgtttgccagttcgatgatggcatcggcgcggttgtagaaatcctgatccgtttcgttggccaaggggcattcctcttgaaagtgggcagatgagcgataggcgatgaaacatgagcctgaagaaagccggcgagtataaaagcctcgcgcctaaccatcgacggcttttgctgcctcgcgccctgccgtattcagccaggccaatgccgctccagcacctgcgccacctgcgggtggcggtcgatgcgctccagcagatcacaacactcggggcgttcgcgccgcagatgctcgcgcgtgccgcaccagcgcgacaccaccgccgcctggaaatccagggccgccaggggtgaaccgctggcgtacagctgcgtggcgaactgatcggcgaacacctcccagttgcggtgcaggcgctcatgggccgcgtcccgtacccgcgccctcagcgcttcatcggcgccttgcagccagcgctccgggtaatcgatcacgctgatcgccgagtagcaattggcggcgataaacaccaggccgcgaatggcctgcgcccgggcgctctcatcctcgggcagcagcgccgagcgcggataacgcaagcccagctcgatcaggatcgccgcgctctcggtgaggacactgccgtccggcagttgcagggtcgggacctgtttcagcggattgagccgcgccagctcgtcggccccgggcgacggcgcccaggacgaggcttcgacgatacggtacggcacctggcaacactccagggcgatctcaacgatggccgagcctgagccttgtgtcccataaagttgatacatgaccatcccctcgcttgactgggccttacatctgacgggtggcttacgcgggttgttcactccagtgccggaagtccgcgaggcgataggtcggatgctggtgaacagcctcggccggcacgcgcagaacggtcccacggtagctcaggcgataggtgaaaccgccatacatgatcttgcggtcggggtccggatgcgccttgaggaaggcttggcgatcgggataaccggtagggtccggaagccgtgccagcttatcgaacagcaccacgtcctcggccacttcctcctgggccatatcaaccagataacgagaataggtgatattcatcgaaggcaaccgtggccccctggcaagcaatccatcaagcctgcgatccagatgcccgaacaccgcgcgataagcactcaccagcagcgcccgccgataaaggctcatcggtttgggagcccgcatacgctgcaccagggagtggatcaatcggttgagcatcccgaaacacgcgatctccagcctcatgccgccttttacttctaaaaacttgccacacgcggaaaatcgggtcttgtgatggacaagcttgttgcgcaccgtgatcgcgtaatcgaaaaccatgatctcgatatgcctgagcaatggatcaggctgccggttcttgcgccggaaaatattcagcttgtcccggaacaacttgtcgctcgtcccgtagtgctggtcgactaccaggtccagatagtcaaacaccacggggaacatcgagagatgctcatggctgtccagagacttgcggaccaatgaggggtgataggtttttgcatcgatatagctatgcgacaccccatccttgatcgtggttttctgacggtaaaccgccagatcattggcaatgtcgaacccctgcaacagctgttcggtaaggcgcagtttcttctgcaaaaagacttcagtgatattcatcaaatactctcgtgttcagtaggtccggcaacgcagacattgcgctcaatggcgcggggtagaacctcgatgcgcagcaccccgtgaacgcccgtcgcacagtcgatacgcaccggcaaaaacgcctcgatcacccggatattgctctgcaggtgctcgctcatgcgcggggtggtgaagctcccgccgccggccagggccatgggcagcagcagttggtccgccaggtgctcggccaccgcggtgccggaatccagccactcgcgggcctggtcgatggcacgatcggccacgctttcggcccgcaggctgctctggccaaaaccgctgaacagctcggtcaggtgctcgaagacgaactccagcaacagcacgttgcccggaccgcattgctcatccaggcgcaccgggctcaggtgctcccgaggcaggtccaggcgagtgccgacgcggcgcaattcgcgctccgccacatgctccggcaggccggcgctcagggcccaggcccgacgcccgagcagttcgccacgctgttccaggtgcaggggttgcagggtcgaaggctggataaaagcctccagctcgccgccgccggcgggaacgaaaccatgacgcagcagctgcaactccacctgcccgcccatgcgccgcagttgcggcagccaggcctgctggaggaaatccaccggcggcgccagcgggttgtgggtgccgccgctgatgctcacgcggctgggctccggggcttgcatcagggccggcagcagggtctgcaacaccagggtgcagctgccggcggtgccgatggcgaaacggtagtcgccgccgcgaatcggccccggctcgaaggtcagcgcccgggaacccagctcggcgcccgagaccctggccgcgcagacctgcgcggccgccagcaccgcggtcaggtgctggcgcagcaaccccgggcgactgcgccgggctcgtatattttggatgcgcagggtcttgccggtgagcatcgacaggctcagggcactgcgcaggacctggccgccgccaatggcgccgtccagttcgatgacatcctgtttcatcacattcctcaggcgtagcgccggacgctgtctcgcaagtaggcgtccagcacagcgttgtcttgatgggtacgcgccagcttgggcaccgggcgttccagttcggcggcgataaaggcgtgcagcgccgggcgccgcggcccgtaagcagactcgtcggcgctgcgtttcaaggccagcaactcatccacttcgtccagcagtggccgatggtcgacggtgtccagcagctcggcgaaggtcatcggcgggcggccgcgcccctgatcgatccagcgcaccgccagcaacggccggagcacgtagaagtacttcttgaaccgcacgctgtcgccttgcaggtagccgcgaaagttcttcctggccatcgacaggtagtgattgcgtgccgccggcggactgtagaaggcctccgccagctctcgcaggcgcgcggttgccgccggctcgcggcgatacaccaggggcgaatccagccactccagcagggtcgggttggacttgcgcagcaacccgagggtcttgcgcaactcccagccgctgatgtccagctcgtcgtccaacggccgctcgatcacgtcccgcccggtgtccacctggatgaaccactcgggcttctccacatagacgaaccgcacatcgtaatcactgtcggtggaggcaaagccccaggcccggctgcccgattcgcaggcatacaacacctgcacgttacgctcgcgctcgatccgcgccagctcacccagtacccgctcgcgcatggcgctgctcagcgggtagcgttcattgaattccatgattccttgtcctgttcaatcgacgatcgccagcacctcagcgctggcctgatcgccttgtacatcggtattcacaacaggcgcttgagcgatccgcgaggcacttcaccggcctcctccatcgcctgcaaccgctgcgccagcgcttctcgcagtggcttgggggtcaccgggtcgaacatcgcgtaacgggcatcgcaccaacgggccagggcctcgcgccaataagcggcttcgctgcccgcccgatccaggcgacacagcaggtattgcaactggcgccagcccggcttgagccccagcaaggcccagcgacgcgccttcggcagcgcatgccagtgctggtccagacgctgttccagggcctcttcgaacgccgaccagggctgctcgcgcagcaggtcgagggcgcagttgaagaccttgtccgacggatcgtccaaggccgccaactgctgggccacgccacgttcgccgagggtctgcagggccagcaggcgcaccgtcagcgccttcgaggccagggcttggtgcagcatggcgtcggcctgcggctcccgcagttccttgaccagccccagcaggcccagccactggcgcttgttgcccggagccggctgctgcaaccggtccaacagcacttgccgtgggtccagcccatggcgtgacgcggcccaatgggccaggcaacgcaaagcccccgaagggtcgagcagggcctgcgccaggtacccgcgacaatcggccaagcgtgacaacagcagccgcaacgccttgacccgcacactggcgccacagctgcgcatcacctcttccagcaaaggcaccgcctgttcgtcgggcagttcggcgcaggcatccactgccatctgccgcacgctgacctcggggtgacgcaacgccatggccagcagcgccggccggtcctcgacgcccttgagcaacagctcgaagacaaagcgcgcggccttgccccgacagctgccaaaggcgctttccacctcgggctgtacctgggccagcagcaacaccgaacgcgcccgctccagggtgacgccatggtccgcccgctgtttgtcggccagggccagcaacggcgccagggcctgcaacagcaaaccggcacgctctggcaccaggtaaaactcaagcgccgcagccgcttcctggcgaacctggggcacccaatcgttgaggcgttccagcagcgccgccaaggcctcggccgatggctgcgcggacaatccacgcaccgcggcctgccgcacgaacccgttgccgaagcggctcagttccagccaggcgctgtgcctgtccagagtgtccatcacttcccgcacgcggcgggcttcgtagtcgctcagctggtcatgccagctgggcggggccgctattactgcgtccatgtcgtgcattgttctaccccttgacgcacaccacctgacgcagggtgtgcagcacttccaccagctcgcgctgggcgtgcatgacttggtcgatgtccttgtaggccatcgggatttcatcgatcaccgcggtgtccttgcggcattccacatgggcggtggcgcggatctggtcggccagggtgaaggtgttcttggccttggtgcggctcatggtgcgcccggcaccatggctgcaggagcagaacgcctcctcgttgcccagcccgcgaacgatgaagctcttggcgcccatcgatcccgggatgatccccagctcgcccttcttcgccgacaccgcgcccttgcgggttaccagcacctcttcaccgaagtggcgctccttctgcacgtagttgtggtggcagttcacggcctccagcgccacctcgaagggcttgcggatcacctggcgggtggcctggatcaccagttgcatcatcagttcacggttgtgccgggcaaaatcctgggcccaggccacggcctcgacgtaatcgtcgaagtgccggctgccttcctcgaagtaggccaggtcgcggtccggcaggttggcgatgtgctggcgcatgtccgcctgggccaggtggatgaacaggttgccgatggcgttacccacgccacgggaaccgctgtggagcatgaaccagacccggttggcctcatccaggcagacctcgatgaagtggttgccgccaccgagggtgcccaggtgctggcggttgttgctgttggccagcgccgggtacttgtcggtgatcgccttgaagcgtggctgcaaggccgcccaggcctggtcggcctggcgcggcacgtcgccccaggcgcccttgtcgcggccgctacgcggcgaggtgcggccatggggcaccgcctgttcgatggcgctgcgcagaccgtgcaggttatccggcaggtcggcagcggtcagcgaggtgcgggcggcgatcatgccgcaaccgatatccaccccgaccgccgccgggatgatcgcgcccagggtggggatcacgctgccgatggtcgagcccttgcccaggtgcacatccggcatcaccgccaggtgcttgaagatgaacggcatcttcgcggtgttcatcaattgctggcgggcttcgttttccacgggcacgccctcggtccacatcttgatcggcttgccgttggcaacttccagcagttggtaggtcttgtgttccatgttcctgactcttttttctgtggctgaaaatccagccttgttcggtggccggtggtccggcataaaacggcgaccagtgaaggcggaacatgcagcgcgctctgccactgagctactcccttgcggttggcgggaatcgaacccgcgaccacgctgtcctgtagttccaccggcattcgccgggtcaatcggtgcaggcagggcctgcgggcagcgacaagaaaacaggcacatttgctctaccgactgagctacagccttgcggctggcggggttcgaacccgcgacacgatgtagtacctgtggcattcgctgccatcccgctcgggcgggagaaaaaactgcgacgacaagggtcgatgaaacagtgcactcgtgttctgaccgttgaactacggcgccttttcaggcaccggcgggactcgaacccgcatcacgaatctgggatgtagttccatcagcattcgtcgctgaaatcgcaaaaaaggtggcacgacaaaagaagtgactgatagccggaatcgaaccggcataaccatgatgtacagccactggcattcgtgccttcacgggccctgacaacatttgctgagacgtctttggatgtagtcacagcggcattcagggcctatgaacaaaaatcttcggcgtgcgccgggtgagcggcgcacggtttatctcatgccttgccgatcagggcgccatcgcctcgatcgcctcgacccagtgctgcgcaccgtagttgcccgcggtgaactgctggatcacatcgaacaccgcgtcgctgaagccgccgacgttgaggatgtcctcgcggtccggcgcctgggtggtggccccgggttgcatatcgatgcacaccagccgcgcctgcgggttgatggccttgatccgctcccactggcgcagggtttcggtcgccccatggcgccgcgcatcgatccacgactcgttgtccgagaccaggatcagggtgtccaccttgcacttggcattggccagttgtgccaggggcgccgagcagttggtcccgccaccgccgatggccgccagtttctgcgcgttgctcatcacgctgtcccgcgggttgaggcggatatccaccaccccgacctcgaacggcatgacccgcgccgccggctgcttgcgcaacaccgctgccgccaccagggccgccacgtcgatgcaacgcaccgccgtggtggcgccctggcgataaccggtgaccgggctgtgcatcgaccccgagacatccgggcacaccaccaccgcgccttgcagcgccggcacgttggccagcgacagctccagggcatcctgcaacgcctcgcgcaccggctgcggcacctcgtccccggccatgcggtaggccgccagcaactggtacgggtagacccgggccttggccacctcggcggcatccgccagccgcgccgccacatactcggtgcaacccggcacctggaacgcgccatggcgagccagggtgttgaggttcatgcgcagcccctgccagcccatattgtgcgcctgttcggcccattgctcgcggctcagggtttcgttgccgagcaactggaacggcacctgcggcaccgccgtggtcgcgccgctgcgaaaggccagcaaggcgcgggtcagctcgggcagagcctgggcatccaccggcttgccgatcaaccaggcgaagaaggctgcgcgccaggcctcgcctggcttgggatgcaccatcttgaccacgtccgccagcgacggctggttgcccaccgcagcctgcaacagctggcgttcggtggcgctgttcaaccagttctgcaccaggcgcttgggctgcgacccgagggatttacgcccggtcgccccgctgcgcaggatctgcacgaagttgcgcagcatcttgccgttgtccaccacctgggcgaacagctccggcaccagggccgagcgttgcgcggtcagcgccgccagcagcaaggccggcatgtctttcatatgacccgtttgccgagcgtaacgagcggcctgggcgacgaaacggctatcgacttcgttcaccagttgcagtaccgcttccagctggccttcgggcgaggtgtagaaggtcgagttcaggcaaccggttaccgccagttgggccaggcggtgcttggcgttgtaggcataggccggggcctgggcggcgttcagggtgttgctcgctggcgctttggcctgttgggtgttgaacagctggaagttggccatcttggcgtctcgctctgtttgtcttgttcgttgccagagagattgcagccgctgtgccagttttatttttttcggcgaattatttttcaacttattgatttataacaattttatttttaaatgatttttcattggcgagtcttcgagacaaagctgctgataattttatatctttgtttatcgctttttatctttaggtataaatatgtcgggcaagcccacggtcgccataggttttgtcggttccaccctcgatcgcgtcggcaagggcgccaaccgctggaaccattggcgccccagtgtcggcctgtgccagcagcaggacgtgctgatccaccgcctggagctgatccacggcctggacgcccgggacgtcagcctggccgagcgggtggccaacgacattcgccaggtgtcgccgcagaccgaggtgcgcctgcaccccatgggcctgaagaacccctgggatttcgaggaggtgtacggcgccctgcacgacttcaccagcgcctaccccttcgacaccgagcgcgaggactacctggtgcacatcaccaccgggacccacgtggcgcagatctgctggttcctgctgaccgaggcgcgctacctgccggcgcggctgatccagacctcccccgcgcggcgccgcgacccgcaggagcacgccaccggcacccacgccctgatcgacctcgacctgtcgcgctacgaccgcatcgcctcgcgcttcgccggcaagcgcctggaaggcctggccttcctcaagtccgggatcgccacccgcaacgccgcgttcaaccgttccatcgaacagatcgagcgagtcgccctgcgctccagagcaccgatgctgctgatcggccccaccggggccggcaagtcgttcctggcccgacgcatctatgagctcaagcgcggccggcatcaggtccaggggcgttttgtcgaggtcaactgcgccaccctgcgcggcgacggcgccatgtcggcgctgttcgggcatatcaagggcgccttcaccggcgcccagaacgcccgcgacggcctgttgcgggcagcggacggcggcatgctgtttctcgacgagatcggcgaactggggctcgacgaacaggcgatgctgctcaaggccatcgaggagaaacgcttcttccccatgggctcggacaaggaagtggacagcgacttcctgatcatcgccggcacccaccgcgacctgcgcggccgggtcgcccagggcctgttccgcgaggacctgtatgcgcggatcaacctctggaccttcaacctgccggggctggccgggcggcgcgaggacatcgagccgaacatcgatttcgaactggaacgccatgcccgcgaacaagggcgcctggtgcgcttcaacctcgaggcgcggcggcgctacctggcgtttgccagctccagcgaggcggcgtggctgggcaacttccgcgagctgtcggcgtccattacccgcatggccaccctggccgacagcgggcgcatcgacgaagcccaggccgaagaagaaatcgagcggctacggtatgcctggggcttgagccaggagcaggatccgctggccactttgctgggcgacagggtcgaactcgacctgttcgaccgcctgcaactgcaggcggtgctcgaagtctgtcgccaggccgacagcctgtccgatgccgggcgcaagctgtttggcgtgtcccgccagaccaaggcccagcccaatgacgccgaccgcctgcgcaagtacctggcgcgcttcggcctggagtggaagcagatagttgcaccagcggattaaggagaactgcctgcggcagccccgccactgtagccgctggcgcagcctgcgatcggctgcgtagcagccgccaaatccggcgacgaggttttccagcaataccgcgctgcatcgttacggccgctgcgtcggagtgccgcccaacccgatcgcagcctgcggcagcggctacacaaagctgtcgccagcaatacgcccaccttcacccagcaggcaccgcatcagctctggcgatcacccgctcacccacctgcaaggtcacggtggtaaaggacatttgcaccacctgtcgccggcgatacgtccactctcaaccacccggcaccgcgaacaccgcgttggccctggccaccacccgctcgccgacctgcagggtgacggtggcaaaggccatctgccggccgcgcttggagtgttccaggcgcacgtcgatccattcgccgacctgcaccgcgccgaggtagtccaggtgcatgctggcggtgatcaatggcagcggcggatcgctggcgaaggccatggcgtagcccatgccgatatcggccaaggtggcaaggatgccgccgtgcacggtgccacgaccattggcgtgacggtggtcggcgcgcaggccgatctccagttgcaggccgctgccacggcaatacaccgggccgatcagctccagcagcgggctgctgcgggacaagggggcataaccttcgggtaacttgagcgagctcatgacgggtctccgttgccgatggcgatgaccgaggcacgggtcatcggtccctgaggtgtacgcccaagcggtgcccgcgcccagccgtatccatccggcaaatccctggcgataaggcgcggcgacacgacacccgcccctccccgcacaatcgacgataagatacgcagccgtcccgccagccccgggcacgatcatttatttcaaggagcgaccatgcaccctcaggacgacacccccaccccgctgcgcagcctcgccgtggtgctgctcagcacgctgctggccgcctgttcccccagcgatcgttcgtcctcggtggcggtcggcggcgcccagggcaaggccggcgcgcaactggcctatgaacatgaactgagcctgtcgctgccctcggcgcagatcgcgccgcgcctggccgccacccgcgaagcctgcgaaaacgccaaattcggcgcctgcaatatcctgcgcctgcaacaaggccagtaccgcgcccaggtgatcctgcgcatcgtgcccgacggcgtcgaaccgatagtcgcgctggccgcccagggcgccgaaatcggcgaacgcatcaccagcgccgaagacctcgccgacgccgtggccgacgtgcagcgccagcaggaacggctcaaggcccagcagcaacgcctcgaccagctggcggcgcgcaaggacattaccgtcagcgacctgatcgccctaagcaaggaacaggcgagcatcgagaacgacctgcaggccctggcccaggtcgccgccgggcaacagcggcggctcgacaccaaccgcctgaccctgaacttcgtgcccaccgacagcagccagcgcggctcgaaactgcaacgcgcgttcgacaacctgctggacaacctcgcctacggcaccgccgaagccctggagaaaggcagctatgtgctgccgttcctgatcctggccttcccgctggtgatgatctgggtctggctgtggcgccggttcgtgcgccgtcgttgagtcgcagcccaagaagcccggcctgatgcgccgggcttttttatgggcacgggcgagcttgtcgtcccgaggatttttatcgcgagccgggccgccccctgccccgccaacatcggctgcccaccgccaggccccaccaaacaaggcctggcgggcataggcgaagaaaactgcacgaacgtacctggaactggcacgtttttcccatgcacctgcagcttgcgaatcgacccaccgcaagagccgcatcgacggtgcctacccgcaccaatagcaatcatcggacgctatccgcgtccccataaagtgcagacggcgagccaaaagctcgttgagctgagactggcgataaggaagtctcatgtgcgatgtgcagtcatgttcaccggcgttttccgctattggctccaccgtttcgcccctggttccgcctcgtccggcagccctgcccggaccggccctcgcgccctgtgcgtcatcgacgatcgaccttgcgcacgctacgcggcgctgcctgtgccagcctctggcgatgccccctgctccagtcgctggggtaactttcaggctggcggtagtggctgttataaggccgaccctctcccggtaccgatatccaagccagtcttcccaggtactgcccagcgtatcccgacacaaacattcgcccccagcccggtctcgccactgtccaagtagcgtcgacggaagaagcctcgacaagaccgatcgtcgactgtctttgaaccactaagcagccaacttcattttgtactcggtgacatttcaccgagcgaaagccgtatttctatcgttgcgtattcgacaacaaacaaacgtgccaaagcgcgttaaaagtggatgatcagagcgttgtccgacaataaggcaattcaatatcaatgcatcgaccactgggtaatgagcggaccgcggtttacatacactcaatgtacgcatcggttaattatccgcacccccagcaggttaataagagctccgtcatcgccctgctcaatggcgggcaggcgagcgcgccatggatactcaagaatgctccccgaacgggccgtaaaagactacagaagccctacgcagagccctgaaaacaacaagatcaaggacctccaggcaatgaccggctagtcactgtttatttgcaccaaatcaattcgccagacgctttttagtgcgttggccacggcattgatcgcccctgtttccggctgaaaagcggataacccagggcaggcaggctcgcccgtaaaaagcatttacggtcaacttttcgaggcgctgaatatatattgttgcgccagtttttctcgcaaatttatataaatgcgacatgcactacgagccgtcgccaattgcataaagaccgacacaatctggcatagcggttgctatatataacgagtacgagacaggtgcattacaaacaccaactcatcccacaacaatgttccagggagtggtaatgaacaatctaagccgaaggcgttaagccactcgtttgcacagggccgttcaaccggatagttcaactatcggcttttgctcacccttgaaaaagttaaacccgactttcgaacattccagccaatgttcgaacggtgccttattgcccttcatccgaccgagggagctttaatgaacgatgcggtaaagaacagaaccctgccgaggcccttggacgatgaagccgccgtccaggttgcgcggggccgtccttataagggcaatgcatcgcaacccggaggcctgagcaagcgccaggtgctgttgctggtgacggtctcggccctgctccatggtggcgcctggtggttcttccagcagacccgcgccgcgccactggaaacgcccccggaaatcccggaaatgaccgtcgagctgagcagcccgaccccgcccgcgccgcctaccccggaacctccgccgcctccgccgccgcccgaacccgagcaaccggtggaagacgaagacgcggtcaagccgccgcccaagccggtggagaaacccaagcccatcgaaaagcccaagccggtcgaaaaacccaagccggtgaaaaagcccgagccgccgaaaacgccggctccacccgcccccgcgccaccggccgcgcccgcggcgcccgcggcgcccgcggcgcccagccagccggctgcaactgcggcgcctgccgcggcccccgggccggtcaaggaatcggcggcggtttccggcctggccagcctcggcaacccgccgccggaatacccgtccctggccctgcgccgcaactgggaaggcacggtggtgctgcgcatcaaggtgctgcccaacggccacgccggcagcgtggaagtcacccgttccagcggcaagccgcaactggacgaggccgccgtggccgcggtgaagaactggaaattcatcccggccaagcgcggcgacacaccgatcgaaggcttcgccacccagaccatcgatttcaaattgccgcaatgaccgcggcccgacctgaactcacaacctgtttacgcatgcgaggtgtagccatgaacgattccctgacatccctgattgtccccggcgtgctctgggccctggtgctgttttccgtggtcagctgggcactgctgctggtcaagtcggcgcagtacctgcggcagaagacccagaaccggcagttcagcaaggccttctggagcgccccggacctgctcaccgccgccgagcacgccagccagtaccccggctccctggcgcgcatcgccagcagcggtttcgaggccctgctggtggaagagtcgccgcgcaccacccagcagctggcccacaccatcaaccgcgccgaccgtctggagcgcaacctgcgccagcagatccagaaggagcgccgggcccttgaaagtggccaggcggtgctcgccagtatcggcagcaccgcgcccttcatcggcctgttcggtaccgtctgggggatcatggaagccctgcagagcatcggcgccagcggttcggccagcctggaaaccgtggccgggccgatcggccatgcgttgatcgccaccggcgtgggcatcgccgtcgccgtgccggcggtgctgatctacaacttcttcctgcgccgcctgaagctggcctcggccagcatggacgacttcgcccatgacttcgacgccctggcccagcgcagcgccttcgccatcagccgccaggccatcgccagcaagaccgcccacgccgtacgggaggccagctgatgtccttctctactcaagacagcgacgaagtgctcagtgaaatgaacgtcacgccactggtggacgtgatgctggtgctgctggtggtgttcatcgtcaccgccccgctgatgaccaacgcgatcaaggtcaacctgccgaaaaccgacgccgtggcccccgccgagaaaaaagacccggtggtggtcagcgtcgaccaggacggcaagttctacctggccaagtccgaagtagcccccgagctactggaaagcagcctcaaggaggtcaaggccaaggacagcgaggtgcgcgtgcagttgcaggccgacgccgccgtcaactacggccaggtggccaaggccatggcctccatcgaacgttcgggaatcaccaggatatccgtgatgaccacccgatgaaggcagtgcctggcgccccctgaggggcgcgccaggcactgcctcgaaaaatcccgtcgcaatcggccgaccgcaaggcgccacgcgcctgcggaggggatcggcttgcttgaagaaagtggttttccggggtcggtacaacccagccggagcaatgagggctcacaaggccatttcgataaacgtctaaaaagtcggaagtaatcatgctgatgaacattccacgtttcacgctcaagccactggtgaccacgctgcaacggcaccgttttgtcccgctgtacctgatggccatgggcctgggcgccggcaccacgcaagccgcggaagaggacgccgacagcagcgccgccgtcccggccgccagtgccgcggccgtggcgcccaccacccagctgcaacgggtcgaagtgacaggttcggcgatccgccgggtcgatgccgaaaccgccgtgccgatcaccgtcctgcgcgccgacgacctgcgcaaacaaggtgtgagcaccaccgccgagttgctgcagcgggtcactggcagccagtcggtgatcaacagctccagttccgtgggttccggcagcggcggcgcctcctacgcggacatgcgcggcatcggcgccaacaagaccctggtgctgctcaacggccggcgcctggcgaacaacgctctgtccggcaccaacacctccaatggctccggggtcgatctgaacatgatcccgttcgccgccatcgaccgggtcgaagtgctgcgcgacggtgcatcggccctctacggcaccgacgccatcggcggcgtgatcaacttcatcaccaagaaatccatgaccgacggccaactgacccttggcggcgaaaccccgacccacagcggtggcggcgcgagcaaggacatgagcgccagctggggtttcggtgagctggaggaagaccgcttcaacgtgctcggggtgttcaactacaacaagcagcaaaacctgcgcgccaaggatcgtgacttcgccacctcctaccgcccggaacgcgggttggaccagacttcgggcacctccttcccggccaactacacccagggcgacaatgccgccaacccactgggcgccaactgcaacggtcccaatctggtagcacgccagggcgtgtgccgcttcgccacctccagctacatcgacctgatcccggaaaccgaaaagacctcgttcttcggcaaggccaccgccaagctggcggacgatcacaacgtcaacctcgagtacttctgggcccgcaacaacaatgccaccaccgtggccccggcgcccctcaccggcctgagcctggactcttcctcgccctactacccgggcaacggcatcaccccggcgccgaccgacttcagcctcgacccgagccagccgatcggcgtgaactggcgcgaaaccgccgccggtgcgcgggaatccaaggaccagaacaccagccagcgcttcgtcctgagtttcgacggcctggtggccggctgggactacaacctcggtgcctcgtacaaccagaacaaagtggtgtcctcggtcaccggcggttatgtcagcgattcggcgatgacctccggcctggccagcggcctactcaatccgttcggcccgcagacccaggccggccaggagttcatcgacgctgcgacctatcacgggccctacaccagtgcggtcggtcgggtcgtcggtttcgacgggcgcgtcagccgcgagatcggcgactggttcggtgctggccccaccggcctggccctgggcggcgagtaccgcaaggagaaattccaccaggactacgagcagttcgtcggcgacatctcgagtctcggcgccgacccggacggcagcgtgtcgggcgaccgcagcgtcaaggcggcctacgccgagatcaacgtgccggtgctcgacagcctggaactgtccgcggccatccgccacgacaaatacagcgacttcggcagcaccaccaacccgaaatactcgttccgctaccagccgatcaaggaactggtggtacgcggcgcctacagcgaaggcttccgcgcaccgtcgctgtacgagctgtatgccccgcaaagcctgaccttcacccaggccaactataacgatccggtgctctgtaccggcggcgtgctgcaaccgggtggcagtgccagtcgcgactgcggccagcaattcctcgcccagggtggcggtaatcaggacctggccccggaaaaggctcgcaacgtgaccctgggtttcgtctatcaaccgatccgcgacctgtcggtgggcctggacttctggtggattcacatttccaaccagatccagccgttcccggaatccacggtattcaacgaagccgggacctatagcaaccgcttcgtgcgcaatgccgacggttcgctgaactacatcgtcaccggcaacgccaacctgggcatagtcgaaaccaacggtgtcgacgtgtccctggactatcgttttcccaataccccctacggccagttcggcctcgggctgcaaggcacctacgtcaagagctacgacttccagagcaccatcaaggggccgttcaccgacaaggtcggcgacttcgagggcgatggcgtgatcgcccgctggaaacacaacctcaccggcacctggaccctgggcgccgcgcgggcctcgctgagcaatcgcttcaccaccggctacaacgactacgaccgcaccacctatgcccgggtagcctcctattcgttgtgggacctgtcggccggctacaccttcgacaaggtgctggacgtcgatgccggggtgaagaacgtcttcgaccgcgacccaccgttctccaaccaggcctacaccttccagagcggctacgaccctcgttacaccgacccgctgggccgcaccctgttcgcgcgcatgacgtaccacttctgagtcaccgccggggccgcgcaagactccggccggccccggccgcattgcgaattcgcgccccatggcggcccgccgccgtgggtcttttcgccctgccgacccaggctttccggcatcacgaggaacctttcgatcatgtctgcactgacccgcaccctggctgggctgacgctggctgccgcgctgcttggcgccgccggcggggccctggccgccgcccatggcagctatgccatgacgatctatggcgaaccgccgaagtacccgccgggcttccagcacttcgactacgtcaaccccgatgcgcccaagggcggctccctgagccgtgcctcgatggagatcggccagttcaactacatcaccccctatgccgaccagggcatcgcggtggcccaggtcaacgactgggtgtattcgcccctggcctttcgctccctggacgagccctataccgtctacgggctggtggccgaacgcatggagcgcgaccccgacggcctgtgggtgcgcttctacctcgaccccagggcacgcttcgccgatggcacgccgatcaccgcgcaagacgtgcgctacaccttcgacctgctgctgagcaagggcagcctgagctatcgccagctgtacggcgacgtgcgggacgtggtgatcgaaggccccgggcaggtgcgcttcgacttcaagaacaacctcaaccgcaccttggccctggacctggcgaccctgcgcgtgctgcccgaacactggtggaagacccgcgacttcgccaacggcggcggtttcgagccgcccctgggcagcgggccatacaaggtcggcaaggtcgacgccgggcgcagcatcagcttcgagcgcgacccgaactggtgggccagggacctgccggtcagccgcggcctgtacaacttcgaccgcctgacggtgaatttctacggcgacaccgacgtcgcccgccagttgctgcaggccggcgccttcgactacaaccgcgagttttcctcgtccggttacgtggtcggctacgacagcccggccctgcgcgacggccgcctgcaacaggcgatcctcgcccccgacaagcccaccgccgcccagggctttgtgttcaacctgcagcagccggtcttccacgaccgccgggtgcgccaggcgctgaccctgctgtgggatttcgagtggaccaacaagcagatgatgcgcggcttctacgtacgccagcagagctactggccgaaaagcgagatggccgccaccgccctgccggacgcccgcgaacgggagatcctcgaacccctgcgcggacagatccccgacgaagtcttcacccaggtctaccgggccccgcagaccgacggcagcggccgcatccgcgacaagcagctgcaggccctgcgcctgctggccgaggccggctggacaccgcggaacaaccgactggtgaacgccgccggcgagccgctggagttcaccttcctcgatggccagggcggcttcgaccgcatgctgctgccgtacaaacgcaccctggcgcagatcggcatcaccctcaacctgcggcgcatcgattcggcgcagtacatcaacctgctcaacgcccgggactacgacatgatcgtcaccagtttcccccgcagcggcgaccccatcgtctccccgggtcgcgagctgtacagcctgtacggctcgcaaagcgcgacccaggtcggtagctccaactccatggtactggccaacccggccgtggaccgcctgatcgatggcctggtccaggccaatagccgcgacgagatggtgcattacgcccgggccctggaccgggtgctgcaatggggccaatacatgattcccaattactactccaagggcacgcccacggtgttccagaaccgcttcggtcggccggccatcgcgccgatctacgacgagggcctgaacacctggtgggaggtcagccccaaggccctgaccacccgccagatgagcgccctgcacagcaccgtggaggcgcactgacatgggccgttacctgagtcgtcgcctgctgctgatcatccccaccctgctgtgcatcctggtggtcaacttcctgatcgtccaggccgcgcccggcggcccggtggaacaggccatcgcccgcctgcaaggcttcggcgggcatgccatgggcggtggcgccgaggtcgccgccgtgggtggcggcggacgcagcagccgtggcctggacccggcgctgatcgaggagatcaagcaccactacggcttcgacaagccgatgcaccagcgcctgtggctgatgctgaagaactacgcgcaactggacttcggcaacagcttcttccgcggggccaaggtcaccgacctgatcctgcagaaactgccgacctcgctgtccctcggcctgtgggcgaccctgatcacctacctggtgtcgattcccctcggagtgcgcaaggcgatccgcaatggcagcgccttcgatgcctggaccagcagcgtcatcgtcctcggctacgccatgccggcgttcctgttcgccatcctgctgatcgtggtgttcgccggcggcagctacctggactggttcccggtgcagggcctggtctcggacaacttcgccagcctcgggcccctggccaaggtcggcgactacctgtggcacctggtgctgccggtgtcggcgctggtgatcggcggcttcgccaccctgaccctgttgaccaagaacagcttcctcaacgagatcagccgccagtacgtggtcaccgcccgggccaagggcctgagcgagcgtcgggtgctctacggccatgtgtttcgcaacgccatgctgctggtgatcgccggcattcccacggcgctgatcgaggtgttcttcgccggctcgctgctgatcgagaccctcttcaacctcgacggcctcgggcgcatgagctacgaggccgcggtgtcgcgggactacccggtggtgttcggcgcgctgttcctgttcaccctgttcggcctgctgatcaagctgatcggcgacctgtgctacagcctggtcgatccgcgcatcgacttctcggcgaggactgcctgatgttcacactctctcctctgggccgtcgtcgcatcgagcacttcaaggccaaccgccggggtcgctggtcgctgtggctgtttatcggcctgtgcctggtctgcctgggtggcgagctgatcgccaacgacaagcccttggtcatccgctatcacggcgcctggtatttcccgatcctcagcgactacgacgaaaccgagttcggcggcgaactgccgttccagcccgactattccagcagctacgtacacgaactgatcgagggccagggcggctggatgctgttcccgccgatccccttcagctacgacacggtcaactacgacctcagcctgccggcccccagcccgccctcggcgcagaactggctgggcaccgacgaccaggcccgggacgtgctggcgcgggtgatcttcggcacgcgggtgtcgatcctgttcgccctggcgctgaccgtcatcagtgcgctgatcggcatcaccgccggtgcgttgcagggttattacggcggctgggtcgacctgttcgggcagcgcctgctggaaatctggtcggggctgccggtgctgtacctgctgatcattctctcggggttcgtctcgccgagcttctggtggctgctggggatcatggcgctgttctcctggctggccctggtggacgtggtgcgcgccgagttcctgcgcgggcgcaacctggagtacgtcaaggccgcgcgggccctgggcctgagcgacggcgagctgatgcgccggcacatcctgcccaacgccatgacctccaccctgacctacctgccgttcattctcaccggcgccatcgccaccctcaccgccctggattttctcggcttcggcatgcccgccggcaccgcctcgctgggcgaactgatcggccaggccaagcgcaacctgcaagcgccctggctgggcctgacgacgtttttcgccctggcgctgattctctcgttgctggtgtttatcggcgaagcctgccgcgacgccttcgatccccggagctgacatgcacgacaacctgattgaaatccgcaacctcaaggtggccttcgccggcaccgaagtggtccatggcctggacctggatatccgccgtggcgaatgcctggccctggtgggcgagtccggctcgggcaagtcggtgaccgcccactcgatcctgcgcctgctgccggcgcagaaggtgcagacccagggcagcatccgctacgccggcctggatctggtgcaggccagcgacgcccagttgcgcaccctgcgcggcaaccgcatcgcgatgatcttccaggaacccatgacctcgctgaacccactgcacacggtggagaaacagatcagtgaagtgctggacgtgcataagggcctgcgcggtcgcgcggcccgggcgcggaccctggaactgctggagctggtgggcatccgcgagccgcacaaacgcctcaaggcctacccgcaccagctgtccggcggccagcgccagcgggtaatgatcgccatggccctggccaacgagccggagctgttgatcgccgacgagccgaccacggccctggatgtgacggtgcagcgcaagatcctcgaactgctgatcgagttgcagcaacgcctgggcatgtcgctgctgctgatcagccacgacctcaacctggtgcggcgcatcgcccagcgggtgtgcgtgatgcgccagggcgagatcgtcgagcaggccgagtgcgaagcactgtttcgcgccccacggcatccctacagccgcttgctgatcgaagccgagcccagcggcgccccggtgcccagcgcctattcgcacaatctgctggaggtggacgagctcaaggtctggtttcccctgcccaagggcctgttcagccgccagcgcgactacatcaaggcggtggacggcgtcagcctgagcctgcaccggggcaagaccctgggcatcgtcggcgagtccggctcgggcaagtccaccctcggccaggcgatcctgcggctggtggagtccgagggtggcatccgcttcggcaacaaggagctgagcatcctcaaccagcgcctgatgcgccccttgcgccggcaactgcaggtggtgttccaggaccccttcggcagtctcagcccacgcatgtcggtgcagcagatcatcgccgaaggcctgctgacccacggtatcggcaccgccgaggaacgcgaggcggcggtgatccgcgtgctcgaggaagtcggcctcgacccgcggagccgccaccgctacccccacgagttttccggcggccagcgccagcgcatcgccatcgcccgcgccctggtgctggagccggcgctgatcctgctggacgaacccacctcggccctcgaccgcaccgtacagaagcaggtggtccagctgctgcgggagttgcaggtacgccacggcctgacctacctgtttatcagccacgacctggcggtggtccacgccctggcccacgacctgatcgtgatcaagaacggcaaggtggtggaacaagggccgtcgcaggcgatcttcagcgcgccgcaacacccctatacccgggagctgttgcaggcttcggggctgcaatggagcccgccgcaggcctgcgaagaaccggcctgaggctctgttccgggggttggcgcagctatcattggcgtcgatggtcaccatcgacccaatgaaattctcaaaaaaaatccgccacgtaacatctgctccataccaaccaaacaacaccccggagcacaccaccatgaaacgccaaattcttctcagcatcgctttctcggttcttgcagcaaacgcttttgccgcgtcctcggcctacccggtggtcgccgaaggcggctcggatcgcctgattgaaaaacgtgtcgccgaaggtggcgccgatcgcttgatcgaacgtcgcgttgccgaaggtggttccgaccgtctgatcgaacgccgtgttgccgaaggtggttccgatcgtctgatcgaacgtcgtgttgctgaaggtggtgctgatcgtctgatcgaacgccgcgttgccgaaggtggttccgatcgtctgatcgagcgccgtgtcgctgaaggtggtgctgatcgtctgatcgaacgccgcgttgccgaaggtggctccgatcgtctgatcgaacgccgtgtagccgaaggtggctccgaccgtctgatcgagcgtcgtgttgctgaaggtggttccgaccgtctgatcgagcgtcgtgttgccgaaggtggcgctgatcgtttgatcgagcgttgtgtagccgaaggtggttccgaccgtctgatcgagcgtcgcgccgtatgattgcgcggtccgcagtactcgaaaaaaagcccggccttatcagccgggtttttttcatttcagggcactgtcagtctctatcgatcaccattcccctgtagccgctggcgaagcctgcgatcggtctgggcggcattccgacgcagcgaccgcaacaatgcaacgtcatactcctccccccacaggcgtctgcttcgcagccgatcgcagcctgcggcagcggctacaacctcgccatgcagcgctgataccgctcatccacccgcttggcgaaccaggcggtggtcagtttgcgggtgatcttcgggctcttcagctggatgcccggcaggatctgccgcggcaaagccttgccctgggcctgatcggccagggcgaatacccgcttgtacagcgtggtgtcctcgaactcgaggctgttgcccttctccagctggttgcgaatggtcgggttgcgcatgtccagggatttgcccagggcgcgcgccgccagctcggtgctgccgggcatgatcgagtcgtagcggatcaggtcgccgtccagcgccagggaaatccccgaggccacgctcagggcgttctggaacgcggcattgcggctggcgtaccagccggcgttgaaatcggcgaagcggtacagcggctgcgggtaattcaccgggtaaccgagcaagtgggcgataccgaaatacatgccgccacgccggctgaacacctcgcggcggatcgagccgtccacgctgtaggggtaattgcgcgcctgctgttcggcgaagtcgatgctgacctgcatcggcccgccggtgtgcaccgggttgaagccgccgaacagggtcttgcccatgggcacgctgccgatgaagtcgtcgaagatcgtgctcagttccttctccgtgcgcgccccggccagacgctcgctgtaggacttgccgttcggtgaacgcacctgcagcgccgcgctgaccagcatcgacggcacatgcaccttggccgcgcggcggtcgatttcgctgcgggcgatcttgcccagccccggtaccggcgggtcgacctgataggtggactcctgctcggccaccgccaataccgcgcagaggttgctcttgctcggctcgatgccctgggcggtaaaggccacctggatatcccgggcccagccctggcgatcggcgaccttggccggcagcaggcgcgccacctgggcctggacctgcgccgggctgggcgccggcgcctttgaaccgaactggccggcacagccggccagggccagcgaggctgcgacagcggcccagcgaagtgaatgcagaggttttatagacatggcttcccagtaattccgaaggtggcccgcgcttgaggtgcatgcgtcgccgcggatatcgaccctcaaggcgccgcgctgttccgtgccagcgacaggccatttgagcattccccgtgaccgacggcgaatttcacctaatctgaaagctcatcgcccacagaaaaacaacaggcggggcccatcatgagcgtgcaactcaaccacaccatcgtctggtgccgcgacaagcaacggtcggcggattttctcgtgcaactgctcggcctgccgccacctgtgcccttcggcccgatgctggtggtgcagctggataacggcgtgtccctggattactacgacaacgacccgcccatcgcttcccagcactacgcctttctggtcgccagcgacgacttcgaaccgatactgcagcgcattcgccagcgcggcctggcgttctgggccgacccgggcaagcagcgagccaatgaaatcaaccgccacgaaggcggtcgccgggtgtattttgatgaccccgacggccacctgctggaagtgttcagccagacctgagcgtcctttacctgccctggagtcccctgtgccatgctctcactggattttctcattacctcgctgattgtcgtgctgatccccggcagcggcgtgatcctgaccatttccacggcgctggtggccggcaagcgcgccagcctgttcaccgccatcggctgcaccgccgggatagtcccgcacctgctggcctcggtgctgggcctgtcggccatcctgcacaccagcgcgctggccttccagggcctgaagttcgccggggtcgcctacctgctgtacctggcctacgccacctggcgcgaccgctcggccttcgccgtggacaccagcgctcctgccaccagcgccggcggcctggtgctcaaggcctgcctgctgaacatcctcaaccccaagctgacgattttcttcctagccttcctgccgcagttcatcagccatgacggcccgtcgccggccatgcagatgctcggcctgagcggcgtattcatggcgatgaccttcgctgtattcgtggtctacggcctgctggccaacctgttccgcaaggcggtgatcgagtcgccccaggtgcagaactggctgcgccgcagctttgccgcgagcttcgccgccctgggcctgaacctggcgttcgcccagcgctgaaacctggtacacgaaaccggcatgacattgatctctcgacgagggcaaggacatgaaccgcagcgacgtactgatcattggcgccggccccaccggcctggttctggcgctgtggctgagccggcaaggggtcaaggtgcgcatcctcgaccagaccgccggccccggcaccacctcccgggccctggcggtgcaggcgcggacccttgagctgtaccgccagctggacctgacccaggccatcctcgaccagggtcaccgggtgccggccgccaacctctgggtcaagggcgaacaggccgcccacctgcccctgagcagcatcggcgccgacctgacgccctaccccttcctggaaatctacccgcaggaccagcacgaacaactgctgatcgagcgtctgcagcgtttcggcgtgacgatcgagcgccagaccgaactgctgggcttcatcgaccacggccacctggtcagcgcccagctgcgcggccccgacggccaggaggaaacctgccaggccttctacctggccggctgcgacggcgcccattcgacagtgcgcaagaccctgggcatcgactttcccggcggcacctatcagcaggtgttttatgtggccgatgtcgacgcccgcgggccggcgctcaatggcgagttgcacgcggacctcgacgaggcggacttcctcgcggtctttccgctggccggcgaaggccgggcacggctgatcggcacggtgcgcgacgaacgtgccgaacaagcgcaaaccctcaggttcgaggacgtcagccggcgcgccatggacaacctcaaggtccaggtcgacaaggtcaactggttctccacctaccgcgtgcatcaccgggtggccgagcgtttcttcaggggccgggccttcctcctcggcgatgccgcccatgtgcacagcccggccggcggccagggcatgaacaccgggatcggcgacgccatcaacctggcctggaaactcgccgcggtgctcaacggcaaggccgaggaacacctgctggcaacctacgagttcgagcgcatcgaattcgcccggcgcctggtggccaccaccgaccgggtgttcagtttcgtcaccgccgacgggccgatcgccaacctgctgcgcacccgcctggcgccgctgctgatccccaaggtgactgcggtggaagcggcgcgcgagttcctgtttcgcacggtgtcgcagatcaccctcaactaccgcgacatgcccctgagctgcggcagcgccggccatgtccacggcggcgatcgcctgccctgggcccacggcgcggtcaccgacaatttcgccagcctcgactacctggggtggcaggtgcatgtgtacggcgtcaccagtgacgccctgcgtgcctggtgcgccgagcggcaactgccgctgacggtgttcgactgggaaccggcgcaccaggccgctggcctcgcgcgcaacggcttctacctgctgcggccggacacttacgtggcgctggcggaaaagtcggcggacccgaaggtgctggaacggtatttcgaggagcgcaagattacgctgtgaggggggtggcagacgcgatagttgaaccgtgccggctgacgtcatcgccaggctcgctcctgcacaggacagcgccgaccctgtaggagcgagcttgctcgcgatagagcccgcgagggctcagccgggatgcgtcagatcccggcgagcgccaggtccatcgcaaagtaggtgaagatcaggtcggcaccggcgcgcttgatcgaacccaggctttcgcgaaccacccgcgcttcgtcgatggccccggccagggcgccgaacttgatcatcgcgtactcgccgctgacctggtacgccgtcaccggcaggcgcgaggcttcgcggatgtcgcggatgatgtccaggtaagcaccggccggcttgaccatcagcgagtccgcgccttcctgctcgtccagcaaggactcgcgcaccgcttcgcggcggttcatcgggttcatctggtagctcttgcggtcgcctttcaaggcgctgccgccagcctcgcggaacggcccgtagagcgccgaggcgaacttggtggaataagccatgatcgcggtctggctgaagccggcctcgtccagggcgcggcggatggcctggacctgcccgtccatggccgccgacggcgcgatcacatcggcgccggcgcgggccgcggccactgcctgcttgccgaggttgaccagggtctggtcgttgtccacttcatggccgtgcagcacgccacagtggccgtggtcggtgtactcgcaaaagcaggtgtcggacatcacgatcatttccggcaccgcgtccttggcgatccgcgacatgcgcgacaccaggccgttgtcgttccaggtgtcgctgccgttgctgtccaggtggtgcgacacgccgaaggtcatcaccgacttgatcccggcgcgggcgtaacgctcgatctccccggccagcttcgattccggaatgcgcatcacccccggcatgctcttgatcggcacgaaatcgtcgatctcttcctcgacgaaaatcggcagcaccaggtcgttgagggtgaactcggtttcctggaacaggctgcgcatctgttcgctgcggcgcaggcgacggggacgggcttgggggaactggctggacataggacttcctcagggcaggccaagtaagacgaggctgggcgcgaaaagaccgcagccaaaagaagcgaagcttatgccccaagccccgaccggcacaaacaccgcgtcgccaaaactgtgtttgcgctctggtaacaatgccgtgaaagcagggagttacgcctgtcagacaaatgctccacggcgaaactgtcgcgtcgattttcgatctaaataagacacgcagagctgcgcaggccggccttgaagaccagtgcctgcggcacttgctcgccgcgtgtgcaggaccttgcgcccgatagaagcgggcccgggcgaatcatctaccggggacgacatcgatgactccagtcgagctccctggcagcacgttcgcgcgatggctgtcgcgggcacaagaaccgggcttgcaggcagtgagcccggttgtcgttctgtcgtggcgggtcgccacagggacgctcgcggcccgcccccttgacccgggaggagaagcgaaaatggccaactccgtgaaaaaaatgccgatccagagtgaagacaaggccacccggcgctcgagcatgagcgacctgtggcaacccctggaaaaactgcggcaacaggtcgatcacctgttcgatgacttcaatcgcggccccggcctgtcacccttcagccgcgggttgttcgatgtggatccgttctggcggcgcgaactgatcggccgcggcatgcccgccgtcgacatcaccgagaaagacgagagcttcgaaatcactgccgaattacccggcatggatcagaagaatatcgagatcaaactctccgacggcagcctgatcatcaagggtgaaaaacaagaggaaacccaagaaaacagaaagggctaccacctgagcgaacgtcattacggctccttcgagcgggtgttcaacctgcccaagggggtcgatgccgaaaagatcgaggcgagcttcagcaaaggcgtgctgagtatctcgctgccgaaaaaacccgccgccatgacggcggataaggtcgtgcagatcaaaggcgaatgacccaggccagccagccccttgccgggaaaacggcaaggggctttttttgtttgacgatgactccagcccggcacttcgctggactgcgcccaagcccgatacagcaggtttatcaattacttaggcgagttcaacataggccggtgctttccgaaacctgacccggcttccggtcgcgtggcgttaggtaaaagcgtgagaggtcacgttttgtcgtcttgtcttatagagtcggcacaggggtgttgccgttcaaggctggaatctttgaaaacacgtcagccataaaatccatgaacacgatagcccgcgtggggagcagtctattggcgacataaaccatctgcacggggacagggggagccgcatggttggtgagaatgaactgtaatctcccgctgttcagcccgccctcaaacagccacgcaggtccatgcgccacacccaggcctgccacgaccgccgcactcacagcgtcgggcgagttgaccctgagcctgccggcaatcggaatgtccgcgtcccggaatcgccaggtcgccccggacgacagcaaggtgtagatgatgcaatcgtggtcgcgtaggtcatccggggtctgcggaactccgcgtttggccaagtagtccttgctggcgacgaagacccggtcgtaccacccaagaggccgggcgcgcaaggcgctgtcctccagatgtcctatgcgaatggcgagttcggtgccttcattgaccaggtctacgtatcgatcgttgagttggagatccaaggtcaattgagggtagcgctccaaaaaggccggcacatgcggcagcacaaacgcgtgtgcgagcgctgtcggacaggctacgcgcaagagtcccgaggggtcgacgttgttcctgaaggacgattcggattcatccaccgcatccaggatgcgccggatgtccgcatagtagcgttcgccctccggcgtcaaggacagcttgcgcgtagaccggtggagcaagcgcgtctgcaaatgatcctccagagccgctacatagcggcttacattgggttgccccagtcctagatcccgccctgccgccgaaaagctcccagtttctacagcacgcgcgaagcatgtcatcaaaagaaatcggtccacttcgtcgcctcaattcatgcttgatttgcatgaattatatgcgaatagacagtcttatctactacgaagcatgagcgcatatttctccatgtcgaccgcggtggtcgtcattcaccggagaattcaaatgtcgcgcttgcaaggtaaacgtacgctcatcactggcggcaccagtggcatcgggctggaaacggcaaagcagttcctggcggagggtgctcgcgtgatcgtaacgggtgtcaaccccgattcgattgcaaaggcccaggccgaattgggcccggaagtgccggtgctgcgcgccgactcggccagcgttgcagcacaaaaggagctggcacaagtcatcaaggaacactacggccaactcgacgttgccttcctcaatgccggcgtatccgtctggctgcccattgaggaatggacggaagatatgttcgaccgctctttcgacatcaacgtcaaagggccgtacttcctgatgcaggcgctgttgccggtcttcgcaaatcctgcttccgtagtgttgacgacttccgtaagcgcgcatgcaggcgcagatcgctcgtccgtgtatgccgcaacgaaggccgcattgctgaacatgtcgaagacgctctcgaccgaattgctgggccgtggcatccgtgtcaacgcagtgagccctggccccgtcgagactccgctttacgacaagctgggtattccggaagcttatcgcgagcagctcaacaaagagatcgcggcaaccattccgcttgggcgcttcggtacctccgacgaggtggccaaggcagtgctgtatctggcatccgacgagtcgcgctggacggtcggctctgaaatcgtccttgacggcggccgcctgctgaatggctaagcgcgcagctcaagaattgcgcgaatgcaacatcgcctgggctgagtcaatcaggtactgaacgcccgcctcagcacttagcgacgaaccagtccaatccagactgtgtaaacagcggtacgcgggaaacctctgccgctgtttccgcttgataaaccatccagagccactaaaagcaatgaacgctcttacgctgataagccacccactatgcccattcgtacagcgcgccgcgattgtgcttcttgaaaagggcatccaattcgatcggataaatgtcgatttatcagccaagccagactggttcctggcagtttcgccaaccggcaaggtccccgtgctcaaggtgcgccaggacaatgcggaagatgcgatcctattcgaaagcatggtcatctgcgagtacctcgacgaaacccaaggtggcgcgccgatgtaccccgttgatgcgttagctcgcgcacggaatcgcgcgtggatcgagttcgcgtcacagacgcaagctgaagtctggcagtttctccacgctcgtgactctgcgaccgcagatgccaagcgcaccgcatttcgcgaacggctcggcaaactggagtcagaaataggcgtggggccgttcttcgatggctcggcctttggaatggttgatgcggtttatgccccgcttttccgttacttcgagagtatcgacgcaactgtcgcacagcaggttttcgacggccttgcgcgcatttcggcttggcgtgaggcgcttgaggcgcgctccagcgtaagggatgccgttgtcgaagactatgccgatcgtttccaaacgcatctgcgccaacaaggagcgctgatcgctgccgcttagccgaagcgatcaatcgacccaagcctttcgatcaggagtcgggaacatgacgaatccatcaaaaagcgctctgatcatcgttgagtatgtcaacgattggctggccccaacgggtggacaaacgtgcatgcttcgaaggtgccaagatccgacctaagttactgttccgtataggtgtatggttcaagtctgtgggtgtcgaggacttgacacaggcccttttttgccggccggcacacccgctcagcgcgagttattgagcgccacggcagccaggatcagcgccttcaaggcggcctcgtcaagcttgtcaccctcatgcagatcgatcgcccaccgggtattgccctcgagactggcattgaacagccctgccgggtcgtccagcgcggcgcccttggcgaaggtcagtttcaccaggttcttgtaggtctcgccggtgcacaggatgccgccgtgggaccacaccggcacccgcgccatttccactcctcgaccacctgcgggtcggcctggcggatcagcccccgaacccgggccagcatctcgccgcgccagtcgcccagctcttcgatgcgcccgtctatacgttgcgcggcagagagcccctcctccgccggtttgctgccggtgccgtcctttttcatcctggtcatcctctggctgaagggcgttgccccgacacctgagtatcgctgaccgggcatttccctccagccaaccgacgaacagttccaggccctcggacaaatgcagcggctgcacaaataccacggcgccaaggcgccctgggtgctggcggcctggaccgagacctggctatcggaggctttcgcgccctggaccctggaaagcagcgcggcctcgatcgactgcccgctgctggtgctgcatggcgcggaagaccaatacggctcgctgctgcatccagaacggatcgccaggctggcgacggcgcgccagcgctgcctgatcctggagaactgccatcacgtgccgcacctcgaggcgatgggggggttctcgatgcggtggatcaacacttgcggatcgataacgcctagctgtaacggcttgcaatcgaacacggccgtgctccaatcaacgcgtttttcggctcagattaattgcgattgacggccccttctactcaccttaaatgcgagtgagcttgcattgcgccgcaccggcttgcattccatttccgttggctcacatgatttgcatctatcagaaatgtctaataccgctcaaggcctcatgttggttagatacagggtttacgacccaaaccattaaaaggatgttcgcatatggctaaccacggatacatgaccatctctggtaaagctcaaggcttgatttcagcaggctgctcaacccaagactctatcggcaataagtgtcagacggggcataccgacgaaatcatggtgctgtcttacagccacaacatggtcaacattggaaatattaataagcccacacacagccccatcattattacaaaaagcgttgataaatcctcgccactcctcgcccaagcactttcaaccagagaggaaataaactgcacaattagtttttatcgcgtgtcgtcctttggcatgcaggaaaaattctattcagtatcaatcaatggcgggattattgctgatctaacacttgaaatgcctcacgctattttgcagaacgacgccgaaccgcaagaacatgtagccatccgttaccgagagatcacttggacccaccatgccgctggcaccagcggatataccacgtggggaaataacgaatgaaaccggaaaatgaaagttgcatgccgggtagctgtgattactggatggtcagtgccgcagctggaaaacttggaagccaagccagcacattagccgttagacacattaaagacggcacgctgcgtttgcaattcaaccgcgaagtcgcttattacgccaaaagcattgttaatgatgtcgcgcagggtaacaaaagccctgagcaggggctgcaagacctcaggaacgaacagaatagcctgctgagccagtcattggaggttgctcaaaaaggcgtaggagtaatcgccggagcatttcaatttgcagcaggcgctgggatttgctatggctcagccggtacgctgtgcttattcccaggctcactcatgatggcccatggcgccaataacatgtatgaaaacggacgtaaccttttagagaatagctctgacacccaaggccccgtcaggaaggtttatcaggagggggctaaactattcggcggcggcgcacttgaaggagacatggcttatgggactgctgacttaggactctctgcatatggcgtcggaaaaatggtattaaagccagatgcttggcgcctattcagatatatccggacggattatgttcgcacctataaagccacaagcaattcagcattgtcattcgaagtgctatctgatggggtaactataaattccatgtaccaagaagctaaagccagtgacaaataattcgataattgcggctactctgtacttgtttttttccttgactgtctttttgacgtttcgctacaccgttaaaaagaaatcagggaaaaacttcaagactggatggttctggcttttattttcatgttcaatactctggggaatgattcagctgaatgtagccagatatggctatatattatttctcccatcaaccaaagatataatttcgaccaattatttaattcgatggatcgcatttataagtgcgctatttcaaacaacttgcattccaattaaagatgaaccaagacgctggttttcacgaaaataactctgcagaaacaggttctcaccagataaacacagcgtttaaacccggctacaaacactcgcctcgagccatgttggctttgggtggccgaatagatgcggtcgcctcatggcgctgaatgcgggacggaattatccgggcgcaagagagggcgggaatcgagagccaggtgcgcccctgtgggcgcacctggttttttacagcgaggggtgaatcagttccacggacggtcgccgtgctcgtccttgacccgggtcggcaggcccatcaggtccagcgccttgaggaacggctcggccggcagctcctcgacgttgaccatgcgctgcacgtcccactcgccacgggccaccagcagggccgcggccaccggcggtacgcccgcggtgtaggaaatgccctggctgtcggtttcggcaaaggcttcttcgtggcaggccacgttgtagatgaacacttcgcgcggctggccatccttggtgcccttgaccaggtcgccgatgcaggtcttgccggtgtagcccggcgccagcgaggcaggatcgggcagcacggccttgaccactttcagcggcaccacttccaggccttcggcggtcttgaccggttgctcggagagcaggccgaggttcttgagcacggtgaacacgttgatgtagtgctcgccgaagctcatccagaagcgcacgttgggcacgtcgaggttcttcgacagcgagtgcacttcatcgtgaccggtcaggtacaggttctgcgaaccgaccaccggcaggtcgtcggtacgcttgacttcgaacatggtgttgctggtccactggctgtcctgccagctccacacctgcccggtgaattcgcggaaattgatttccggatcgaaattggtggcgaaatatttgccatgggaaccggcattgacgtcgagaatgtcgatcgaatcaatgcggtcgaaatactgttgcttggccagggccgcataggcgttgaccacgcccggatcgaagcccacgccaagaatggcggtgacgttcttctgctggcattcctcgaggtgtttccactcgtagttgccataccagggcggcgtctcgcagatcttgcccggttcttcgtgaatggcggtgtccaggtaggccacgccggtatcgatgcaggcacgcagcaccgacatgttgaggaaggcggagccgacgttgatgacgatctgcgattcggtctcgcggatcagcgccttggtcgcctcgatatccagcgcattgagcgcataggccttgatttcagcgggctgtttgaggctgcccttggccttgacgctgtcgatgatggcctggcatttggagatgttgcgcgacgcgatagcaatacgaccgagttcgtcgttgtgctgcgcgcacttgtgggccaccaccttggcgacacctcctgcaccaatgataagaacgttcttcttcaatttctttatctctcctttccgccagcttacgagaggctggacaggtagtcttcgaacccaaattcacgaaccacctcgacactaccgtcgagttgtttcactacgatggacggcattttcaggccgttgaaccagtttttcttgaccatggtgtaacccgccgcgtcaacgaacgacagccgatcgccgatggtcagcggacgatcgaattggtactcgccgaagatgtctccggccaggcaagacttgccgcacaccatgtaggtgtgttcgcccgtgctgggtgccagcttggcgttcaggcgatagatcagcagatcgagcatgtgcgcttcgatggagctgtcgaccaccgccaggtgcttgccgttgtagagggtgtcgagcacggtgacttccagcgacgcgctctgggtgatcgccgcttcgcccggctccaggtagacctgcacgccgtactgctcggagaacgccttgaggcgcgcgcagaaggcgtccaggtcgtagccttcgccggtgaagtggatgccgccgccgaggctgacccattcgaccttgtgcagcaggtggccgaagcgttcctcgatggtgcccagcatctggtcgaacaggccgaagtcggcgttctcgcagttgttgtggaacatgaagccggatatctgctcgatgaccgcctcgaccttcaccgggtcccactcgcccaggcggctgaacggacgcgccgggtcggccagcaggtaatcggaactgctcacctgggggttgacccgcagaccgcggaccttgcccgcggacgcctcggcgaagcgctgcagctggccgatggagttgaagatgatcttgtcgcagttgtcgagcatctcttcgatttcgtcgtcggcccaggccacgctgtaggcgtgggtctcgccggcgaacttctgccggccgagcttgagctcgtacagcgacgacgaggtggtgccgtccatgtactgctgcatcaggtcgaacaccgaccaggtggcgaagcacttgagcgccagcagggccttggcgccggactgttcgcgcacgtaggcgatcttctccatgttgccgagcagtttctgtttgtcgatgaggtagtacggcgttttgatcatttcgaggcctccggccaggccagccaaaaaaaggatgcgcattgtgccttcacttgctgcgtatcgaaagggcagaaagcaccgctcgccgggtcagtgcctcggcactgtgtccggataggcgccgtcgcaggcaatggaccaggacgcaaaccgcctggcagcccctatcctaggggcccgccatgacgttctgaagtggcgcgccgcggtggctggcgcatcgcactctccgctcaatcatcctcgtgcaatttgatgccccgggcatgcagcaggtggggcaccaccagcaccagcagggtcaagccgaggaaggccgcggatatgggttgggtgacgaagatcgaccagtcgccctggctgatggacaaggcgttgcgcagttgtttttccgccatcggccccagcagcatgccgacgatcaccggcgcgacggggaaatcgaaacgccgcatcagcaccccgccccagccgatcgccagcatcagcaacaggtcgaaggacgaatggcgcatgccgtacacgccgatggaggcgaacaccaggatcccggcattgaggtacggccgcgggatctgcagcagtttcacccagagcccgaccaacggcaggttcaataccagcaggataacgttaccgatatacaacgaggccaccagggtccagaccagctcgcccgaggtctggaacagcagcggccccggctgcaggttgtagttctggaacgccgccaagaggatcgccgcggtggcggaggtcggaatgcccagagtcagcagcggcaccagggaaccggtggcgctggcattgttggcggcttccgggccggccaccccttcgatggcgcccggccctttgctggcggcaaagtcttgcgggtgcttgctcagtttgcgttcggtggaataggacaggaaggtcgggatttccgcgccaccggccgggatcgagccgaacggaaagccgatcagggtgccgcgcagccaggcgggaatcgagcgtttccagtcctcgcgggtcatccacaaggacgtcaggcgatgccggccggacgcttcctccttttgatacagcaggctgtacaaggcctcccccacggcaaacaggccgaccgccaccagcaccacctcgatgccatcgaccagctcgggaacgcccagggtgtagcgggcaatgcccgaggtcgagtcgaggccgatcaggccaatgcccaggcccagccccagggaagcgaaaccgcgcagcatggacgcgccgagcaccgccgacaccgtggtgaaggacagcaccaggatcgcgaaatactccgcggggccgaacttcagcgccagcatggcgacgatgggggcgaacagggtcagcagcaccgtggcgatggtcccggcgaaaaacgagccgatcgccgcggtggccagggccggcccggcgcggccgttgcgggccatgagattgccctccagggcggtgaccatcgaggatgactcgcccggggtattgagcaggatcgaggtggtcgaaccaccgaactgcgcgccgtaatagatgccggcgaacatgatcagcgcgccggtgggatcgaccttggcggtgatcggcaacagcagcgccacggtcagcgccgggccgatccccggcaacacgccgatcgccgtgcccagcaggcagccgataaacccccagagcaggttgatcggcgccagcgccgcggagaaacctgtcgccaggctcaagagaatgtccaccgtgtgacctccttcggcccggttcagatccaggcgttgaccaggggtggcagggccacgcccagcccggcgttgaacagccagtagatcggcagggtcagggcgatgccgatggccaggtcccgcagcggccgccggctgccgaaaccccgggccgaacaggcgaacagcaagccggcggccaggacgaaaccgatcaggtcgatcagcacggcaagcgccaccaggccggcggtgacccaggccacgcccagcctgccaccgggcaaggcctgggcggtttcgtcgtcgtgggcggccagttcgcggaaaccaccggtacaggcctgatagctcagcaacaggcccacggcgccgaggaagaccgcgaccgcgctgggatagacatgggcaccgaggatgacgaagcccatctcgggcggaaagcgcaaggcgccgatgaccagcaccaggctgatggcgatcagccccaggccaatcgccaactgcgacagcacgaccctgctgcgcccggccatctcaaagcagcccgaccttgaccagcatcgcccgcaggcgctggtgttcctcgtcgacgaactggccgaactcgtcaccggtgaggacgctcggcgaccaggcgttggctttcacattgtcctgccagaccttgctgtgggtggcggccagcaccgcgtcggtgacttgcttgcgctgctcggcgctgaggttggccgcgccatagacaccgcgccagttgccgatgatcacgtcgtagccattctccttgagggtcggcgcatcgatgccgggcacgcgctccggagcgccgatggcgagcaggcggaactgcttggactgcacgtacttggccagctcggcataaccgccggtgatcaccgtgatgtggccgcccagggtcgcggccaccacttcgccgccgccggcgtaggcgacgtagttcaccttgttcaccggcacgtccatcttgctcgccagctcggcgatgccgatatggtcgatggaacccttggagccgccgccccacttgatgctggccgggttggccttgaagtccttgagcaggtcttcgagggtcttgtagggcgaatcctcacgcaccgccagcacgttgtattcggtgaacagccgggcgatcggcgtcacgtccttgaggctgatctgcggcttgttctgctccaccgccgtgaccatgatcgcccccaccaccagcagcgcattcgggtcgcccttggtgctgttggcgaactgcgccaggcccagggtgccgccggccccgcccttgttctcgaaggtcacggacttggccgtgccggcctcgagcaaggccttgcccaagacccgcgcggtctggtcataaccaccgcccacggagcccggggccatgaacttgaccgtatccagggcaaacgccggggttgcgagggtgagcgtggcgaggctggcgacaagggccatgccgcggctgaatcgacgcagtgctgtaaacatcaggtttctcccgagactattgtttttgttgataccggttgaatgcgcccagggctgccgccctgtgtggcctgcgattaagtgtagacggccggcggtgggcgaccgccagagcagagaacccagggaaaacaaggcgcccagagcctggattcggggtgggttggccggcatgcaacccggccgtgccaatcagcgagggaggatcagcgattcggccaaagaggatcggcgatccttgccatcacgagcgggtcttcacggtgatgaacatgtgcagccgatcgtggatctcctggagggtgtggcgaaacggttcatgtttgtcgctggtgaccgggtcctcgaagttccagacgatcacctcgccggaggacggcatgcgcgcggcctcttccgaggacttgtcgcacagggtgatgacatagtggaactgctgcccggcgaactcgtcgagggccttgctgcgcagcccgtcggtggcgatgcccaggcgttgccccgccggttgatcccggcgtgaccggtgaagggttgagttagagcgacagaacaccctggcgggaacaggtgtctggaggaaagccagccgcttgtgcggacaaggctcggtcatcagttgttacatatcaggccatgcagcacgccgaagcgcagccccggttcggaaggcgtcatatgggtgacgccaaacaccttgaacgccgccagcatcaccgccaggccaccgggcaggatgcccaggcgatgggattgcagcccggccagccgcaggcgcttgacatgcccggcctccagcaggcgcaacgacaggcgcaacagcccgccgtaggtgatgccgtcctggccatagtcgttcaggccgttggccttgagcaccttggccaggaaccgggcggtgcccgaggagcctatggcctgctgccaaccgagctggcgataacgccgggcgactttctcgaacttcaggctggccaggcgctcggcttcctgcagagcatgagccgagaccgcgccgcccggaaagtagcgcgcgccgaagctcccgctgccaatggcgatgctctcggtcagcaagggctgggcgccctgcccgaggatcaactcggtggaaccgccgccgatgtccaccaccagccgcatgctttcgctgcccggcaccgtatgggcgacgccggcatacaccagccgcgcctcttcatgcccggaaatgacatcgatgcgaaaccccaggtggcgctcggcgctggccagaaacagcggcgcattgtcggcttcgcgcacggcgctggtggccaccgcccgcacccgaccggcctcgaaaccgcgcagcttcttgccaaagcgcgccagtgcctgccagccccggtccagcgccagctcgtccagggcgccctcctggaaaccctccgccaggcgcaccggctcacgcagggtcttcacttcctggatcatgaacccctgactgcgccggaccggctggccgatcatcaggcgaaacgcattggacccaagatcaatggctgcgaacagagaggcgtcgcctttcatgggggattcctggcagattcatcgaccggcaggccgcagcctgtcgactactaaagacggtttgcggcgatcttgccatggcgtcgatgacgccaagatgacagccgcccgccttgatccgccctgccccctggttgcgctcacataggccttaccctgcctcagcccggtcacgaaagcttttcggcggcaaggaggctgtcatcattgggtcatttttcgcagtgatactcgcgttatcagcaacgcgtgctctcctttaacgctgccatcttgggcggcttttttttgcccgaaaatcctcgcgaccaccttgccggatcgagacagcctacctacccatcaagggctgcaacatccatcaccaccgctgctgcgaccgcgtcggcacaaggctcgccgcgatcgtccaggcggctgcgagcgaacagggccgctgaacgcagggcttgcctggccgaacgcaagtagaacgcctgcaactgaaacacatgccacctcgcggcatgcacttccaggcgacaggccacgccgcagtgcagcgcgcgctcggccaggcgtgtggcgtccgccagcagcagttcctggtcgcccacctgaatcagcatcggcggcagcccacgcaagtcggcgctcaatggactgtgcaacgggctctgggcaggcgctgcgtaggcgcgcagcccttgctcgagccaatcgcgtcgcagcatggggtcggcgtactgacgggtgataagggttggcccgctcagcgtcgtatccgtcaccggggacaacagcagcaggcccgcggcaaagggctcgccccgctgttgcagcgtcagcgccagggccaggacgagagagccacccgcggagtcgccggccagcaggatctgccgcgccggatagccttgcgcccggatcgcctggtagcaggccaacgcatcttccagggccgcgggaaacggctgttccggcgccagccgatagtccggtacccagacggccatcccccgcttcccgggccaggcggctggtaacgctgcggtgagtggctgggccgcccaggcagaaggcaccgccatgcagataaagaatcaccccacccgcctcggcatgggccggtgtcaggattcgcagcggtacgcccgagacgtgagcccgtgcctgattcacgccaacgcagcccggcatcaaccaggacaggccgttgacgatccgccgctgggtggcaatgcttcgcggcggaccgatcagcgcccggaagctcacccgcaagagttggcgcaacacgccggcactgaggacttcgaggccatcgcggggctcggcgatcacccgcccgtagacctgccccgactcgctggccagcgccctggagaaaccataggcgcgcaatgccgaataacgggtcagccagcgataggacaaggtgaagcccggccagttggtgctgttgttgcccgttgcgtcgacataccagctcttgcaaccgctccacacggaaccggccaggcggcgctgtatccgttgatgaaaacgctgctcagcctggtcatcgacctcgacggtggtggccgcagccttgtgcatcgcgcgccagcagcgcatgacatgggatatctggctttccagcatgtagacgatcgagttgtgccccaggttggtattggggccatacaacatgaagaagttgggaaagcccggcaccgccagccccagatacgcacgtgcgccctgctcccaggcatgctgcagctccaccccgccgcgcccgacgatcgtcatcggtgcaaggaactgcgtcgccgcgaaccccgtgccgtagatgatcgcatcgacctggtggtgcttgccgtccagcgtctcgatgccctgctcggtgatgcgcccgataccctcggtgatcaactgcacattgggccgggccagggtcttgaggtaatcgctggacagcaggatgcgcttgcagccgatggggtaatccgggatcagttgccggcgcagctgcgggtcgctgaccgactggttcaacaagcggcgaaacggcaggccgaccgcccacttcatcagccccttgaagcgggtaaaacccagggccctggattcgtagcgcaggtagatggcggcacgatgcagcgccatgcgccacggcctattggcgaacagctgcttttcttcgtcgctgtaggcgcgatcgggccggggcaagatgtaggccggagagcgctggaataccttgagctgcgccaccgggtcggcgatggccggcacgaactgaatcgccgaagcgcccgttcctatcaccgccacccgcttccccgccaacgaatagccgtgatcccagctcgcggaatggaacacacgccccttgaacgcctgcatgccttcgaacgtcggcagcgccggccggctgagctggccagtggcgctaatcagcaaggcagcgcgatgcacccgcccaccgacttcggtgatgcaccactgcgcgctggcctcgtcgaatcgcgccgcccgcacttcagcgccgaagcggatatgccgctgcacctcatacttgcgtacgcaatgctgcagatacccctgtatttcggcttgcggggcaaacatccgcgtccagccggggttgggttcgaatgaaaacgaatacaagtgcgacggcacatcgcaggcagcgcccgggtaactgttgtctcgccagacgccgccgacatcctgctgtttttccagaatgatgaagtccgtgacgccggccttgcgcagcgcgatggccatgccgatgccggcaaaaccgctgccgatgatcacggcggtgagtggcgccgtcgattgcaggtcaggttcgagttggggcatgcagcacctcttttgttgtttttttcatgggcaggcacaggtcttcgcatgatcaggtcccagggcttcccgctaatcccgatcagcgtagcctgcgcacccatcatgcttgcccgccctcgccagtcccatgacgtaacgggacagatactttagtattcaggccaattcctttccctgacccaggtcgcgagcatgaacatgctggagttgtcgcggggaccggccagtgccctgctgatggtggatttcggtcgcgaaagaggcttctcgcctgcgcgattgctggccggttcgggcctgtcgctggcccggctggcagatcccaacttagagctgtcatgcgcccaggaactgcgcctgatcaataacctgctcaacctgtcggggcacccacaagggctgggctatcaagtgggcgagcgctatcacttctcgacctatgggctgttcggttatggcctgatcagcagcgcgaccgcgggtgacgccttgaagctggccctgcgcttcttgccgctgacctacgcgttcacccggatcgcctaccatgagcaacctccgctcggcatcctgacgttcaccgaaccggcgctggcggacgagtcgctcagagactttgtgatcgaacgcgacatggccgccgccgcggtgctgctcaaggaaatagctggccgcgagttctcgctggcgggttttaccctgaagaagaaacgcccggtcgatcaggtggcggccagtgccggcaatattcttggcatccgccccgcctacctcgccgaccgcaacagcctggccttcgatcgttcgctgctgagccgcccgctcccccaggcaaacaccgtcaccgtcgcgatgtgcgagcagatgtgcgcgcaattgatggagcgccgcagcccccgcacgggcaccgccgagttggtccgccagtacctgaacatcgcccccctgggcgtaccgccagacctgccgggcatggccagcctgatcaatctcagcgagcggaccttgaaacgacgcctgcacgaggaaggcacctgttaccgacacctgctggagcagtcgcgcagcgccgcggccctggagttgctcggcgacccgacgctgaaactgacagacatcgccgaaaaactgggctacagcgacctgtcgagtttctcccagaccttcaaacgctggtacggcgtatcccccagaagctatcgccacgcgtccaaggccacttaggcaacagacaggccgggcctgactgcaaagcgccctcgcctacaacgtcaggctgccctcgatacaggtcaccaccgagccgccgatccagatttcatcgccgacctgctcgacctggatgcgcccggcccggcccatgctcaaaccctggctgaccacgtaggacgccggcgccaaccccgcgcccagcaaccattgggcgatgccggcgttgaggctgcctgtggccgggtcttccggcatgccgtcgccggcgataaaggcccgcacttcgaactgcgccgcgtcgccatcgcgctcggggttccagggggcgatcactccgaccgcaaggcccttgagccgcgcatagtcgggttgcaggtcgagcacctggccgcgctcggccagcagcaccgccagccagccggcaccgttgtccacccattgcgcgtcgacgatggcatcgggcgccagcctcaggccctggcgcacctgctccagcaatccgtcatcgaccgggccagacttgagcaagggcggcgcgagaaacgccagctcggcgccgttgcggcgaatgcgcaccaggccgaccgcgcactcctggacgatctcctcgcccttgggcacgccgccggcttccagccaggcatgacagctaccgagggtcggatggccggcgaacggcagctcctgcagggtggtgaaaattcgcaggcgatagtcggcccgcgggtcccggggttcgaggataaaggtggtttcgctgaggttggtccagttggcgaatgccgccatgcgcgcgtcgctcaactcatcggcgccgaacaccaccgccagcgggttgcccttgagcggctggttgctgaagacatccacctgcttgaaatcgaatcggctcattacgggtccttgtctgaatgaacacggccaggcctggaaccggcctgacctgcaaaaaaacatacctgtagccgctggcgaagcctgcgatcgatgacgcagtcatcgcaaaaggacccacgcgttgtgccagacagaacgcgtcgtcaggttctacgacgactgcgtcgccgatcgcagcctgcggcagcggctacagagagggcggtcagaccggcttgggaatttccaggccgcggatcaccgccgggcgcgcgaggaaacgctcgagcacacgctgcacgttggggaagtccttgaagcccaccagatcgcccgcttcatagaagccgatcaggttgcgcacccaggggaaggtggcgatatcggcgatggtgtagcgctcgcccatgatccagtcgcgaccttgcaggcggccctcgagcacgctcagcaggcgacgggattcggcgacgtaacggtcacgcggacgcttgtcctcgtagtccttgccggcgaatttattgaagaagcccaactggccgaacatcgggccgatgccgcccatctggaacatcagccactgaatggtctcgtagcgcgccgcggattcctgggccagcagttgcccgctcttgtccgccaggtagatcaggatcgcccccgactcgaacagcgccagcggctggtcgcccgggccgtgggggtcgaggatcgccgggatcttgttgttcgggttcagcgagaggaactcgggggacatctggtcgttggtttcgaaactgacgcgatgcggctcgtagggcagcccgatctcttcgagcatgatcgagaccttgacgccgttgggggtcggcaaggaatacagctgaatccagtcggcgtactgcgccggccatttctgggtgatggggaatgcatggagatcggtcatgacaggcttccaatgacagtcagatgaaaggccgtggcccggggccgggcgcgacggcgctagattacaggcatcggtccgcggcgcgcattcttaaattcgaaacatccggtggttaagcttcccggcagccagacagcggtgcggataaagtgacggggccacgctcgcagccccacgcccggatcgaaccaaaaggcgtcctgggactctgagcactacctacgggtagaacactcgttcaacgacagggaaaaccacgcgaagcgggagctcgccgtggaaaggtttgtcagccttaaccgattgcgctgaagtaccgacgatccatgaagaatctgctgagtttcacccaacgcctgcaacgccggtcctatgtgttctttccggcgctgctgctgaccagtgggctgctgctgtcgctggagtccagcgaaagtcgcgcccagccggtggacggcacccagaccctggtctttttgcgccacgcggaaaaacccgccggcggcctcggccagctcaactgccagggcctgaaccgcgccatcgacctggcgtctttgttgccggaaaaattcggcaaggccaattacgtgttcgccgccaacccgacgcgcaatgtcgaggaaggcgagctcgacaactcctacagctacatccgcccgctgatgaccatcagccccagcgccatcaagctcggcctgccggtgaacatcgaattctcggccaacgacaccagcgaactggccgatgagctgctgcatgaccgctaccacaactcgatcatctacaccgcctggtcccacggctacctgccggagctgatcaacaaggtggcgcgcgaagccgtcggcgaaaaacgcaccatcaccgacgactgggcctccaacgacttcgactcgctctacgtgctgaccctgacctggcacaacggcaaggccaccctcgacagccgcagctacaagcagggcctggataacggcgaggaaaactgcccgacctgatgcgccgccctcagcgcagggcgtccagcaggcggtaccaggcgatccccgcccccaggtacagacgctgcaaacgatgcagcggaatcggccggatcggcgtcaccggaaacggaaactcactgctcgcccccgacagccgcgccgccaggtgcttgcccaaggccgtggacaaggcgatgccgcgaccgttgtagccgagcaggatcgacaaccccggctgcggctcatgcagctgcggcaggaagctctgattcaacgccactcgcccgctccagcgatactcgatgggcgtgcccgccaactgcggaaacaagcccagcaacgaacgctccagatgacgccagtcgccgctgtggctcggttcggaaaacggtccgcgcccccccagcaacaagcgcccctgggcatcctgcttgaaatacagcagcaggcgccgggcgtcggaacagacctcgccgttcggcaggatgccctgacgcagctcggccgacagcgggcgggtggcgatgatgaaactgttggcagcaatcaccgtctgccgcagccgtggccacaggtcgtcggtgtagccattggtcgccagcaccacgcgctgggcctggacccgatggccctgggcggtgcgcagctgccactgcccgccttcgcgctgcaaagcctcgacccgagtctgcccgtgaatccgcacaccctgctgctgcgccaccctggccaggccgcgcgcatagttcagcgggtgcagactgccggcgcgcggatcgacccagccgccgaggtagttctggctgccgatgcgccgaccgacagcggcgcggtcgagcaactccaccgccaccccgcgccggcgccactgctcggcgcgctgttcgatggcctgcaggggactggcggaaaacgccggctgaatccaacccttgcgcgtcgcatcgcaggcgatgcgatgctgctcgatcagggcgaacacttcgtcggcggccgagccggccgcctccagcatggcctcggcgcgggccgcgccgaacttggccagcaactgatccgggtcgtacttgagcccgggaatcacctgcccgccgttgcgtccggaggcaccccaacccggctccccggcgtccagcacacagacgctgaccccggcctcggccaggcgcagcgcggtcaccagcccggtgtagccggcgccgactatggccacgtcgacccgcaggtcttcggccagcgccggggtctcgaccgccgccgtcgccgtggcggcccacaaggaaggcggcaggcgcaaggtttcggcggccttcatgcctgcacctccgcgccctggttgagcaggcgcttgaggaagtcctgggtgcgcggatggcgcggcgcgctcagcacctgcttcgccggcccggcctcgacgatcttgccgctgtggaggaaacacaccttgtccgccacgtcctgggcaaagcccatttcgtgggtgacgacgatcatggtcatgccttcgtcggcgagcttgcgcatcaccgccagcacctcgcccaccagctccgggtccagcgccgaggtcggctcgtcgaacaggatcgcctgcgggtccatggccagggcccgggcaatcgccacccgctgctgctggccgccggacagctcgtccggataggcgtgcatgcgatgggccaggccgactttttccagcagcgcctcggcccgctcccgggcctgctgcgggttctgcttcctcacgtagatcggcccttcggtgacgttctgcaacgcggtgcgatgggggaacaggttgaagcgctggaacaccatggccacctgggtgcgcagctggtgaatggtcttgccatggcggtcgacccgctcgccgctgaccaggatgtcgccctgctcgtagctttccaggccgttgatgcagcgcagcagggtcgacttgccggaccccgaggggccgatcaggcacaccacttcaccgctctgcacgctcaggtcgatgccttcgagtaccgccacgttgccgaaactcttgtgtacgcccttgatctcgatcatgactttctccgggtgctgaagcgcgcctccaggcgacgcagggcaaaggacaacggcaggctcagggccaggtagagcaaggccaccagggtgtagacggtcatgttctcgaaggtcgaggacgcgatgagctgaccggcgcgggtcatctcggccacggtgatggtggacaccagcgaggagtccttgagcatcatcaccagggtattgccatagggcggcaaggcgatgcgaaaggcctggggcaggaccacccggcgcatgatcatgccgccgcgcatgccgatggattcggccgcctcgatctgcccctggtgaatggcctggatgccggcgcggaagttctccgcctggtacgccgagtaggcgatgcccaggccaatcaccccggcctgcatggccgtgagctggatgccgaaatccggcagcacgaagtagatgtagaacagctgcacgatgatcggcaggccgcgaatgacgttgaccacgccaatcgcgaacagggagatcgagcgcaccttggacaccatcatcaaggcgaataccaggccgatcagcgagctgagcacaaaggagccggccgtgacctgcaaggtgaccaccgcccctttcagcagaatggggaggaagtccagagcgttctggagaaacataggaggacctgcgcaatcaggagtgaagcgaccccgccggacggccgggccgcggggtggtcagttgagcttccacttctcgatgatccgctccagggagccgtcggccttgatcgccgcgatgccgcggttgacctcgtccagggtctgcgcatcgcccttgcgcacgatcaggcagacatcgcccatcaccaccggttggtagcttttcaccagctgcaccttgttctgggtgccctgggccagttggtaggcgacgatcggccggtcggcgaaaccggccttgatccgccccagcgccaggtcgcgcagcaggtcggggatcgagtcgtagccgcgcacttccttgaagatcccgcgcttgttcaactcatcgatgaacaccgtgccgacctgggcaccgaccacctggtccttgaagtcctccatgcgggtgtaggcggtgttgtcgtcggcgcgcacgatcagcccctcgccatagctgaacaccgggttggagtactgcatcaccttctcccgcgccggggtgcgcagcatggcggcggaaatgatgtcgatcttgttcgaggtcagcgaggggatcagcgcggcgaaggtggtctgctggatgtccacctcgaagccgccggcctggcccaccgcacgggcggcgtcgatcatcatgccttcgatgctctggctcttgacgtcgagaaaggtgaagggaatgccggtggcggtggcgccgaccttgtacaccggcgcggcgccggcactgacagaaccgacgaggccggcggtgagtgcgcagcacaatgcaaggacacgaaaacgcttttgcatggcgaatctcccattggacgattttattgttggaagtccgtgatggttggcctctgaaagtggggcaggaggcatgggctcgactataaacaatttacaaaaatcgtaaagagatttataaatatcgaatatcgatatttaaaacacaaaaaatcaaaggaaccgccatgagcgacacccccaatagcctgttcaatcagtcgctggaaaaaggcctggcggtcctgcgcgccttcaacgccgcccaacggaccatgaacctggcggaaatcgccgaggccgccgagatcaacaaaagctcggcgcaacgcatgatccacaccctggagcagctcggttacgtgcgtaagcacccgcagaccaaacgcttccagctgaccccgcgggtgatggagatcggctacaactacctcgccgccgacaccctggtggacgtggccaacccgttccttgccgagctggcccaggtcaccggcgaaaccaccaacctcaccgagcccgacggcctggacatggtctatgtcgcgcgctttgtggcgcccaagttcattccgatccacatgcccatcggcagccgcatcccgatgtactgcaccggttccggccgcgcctacctcagcgccctgcccgaccaggaagccctggcgatgctccaggccagcgaccgccaggcccatacccggcacaccctgaccgggatcgacgcgatccatggggaaatcgtcgccacccgccagcgcggttacgccctgaaccaggaagagctgtttctcggcgacatgagcatcgccgcgccgattatcggcagccagggcctgccggtggccgccgtgcacgtggtgatccccagcagccgctggaccctggaagaagccgaacgcaagctggcgccttcggtgatcgagtgcgcccgggcgattcgcacctcgattcgtaccctctgagtggccatgacccttttgtagtcgccggtgcggattccgggatttggcccggcactccgtgttgcgaggttttaccaccgctgcgcggtcgatcgcagccttcggcagcggctacacaggcgcgcaaggtgcgcgagtaggctaagattcgcgacctaacgtcattgcccggaatcactgttcatgtccagccttgcccctgccagccccgtccggggctggtcgttctggtggaaacccgccctgttcgtcctggtggcgtgtgtcggcctctacttcgtcaagtggtcgccctactacaccaaggcctttatcgccgccgacagccacagcatcggcgcctcgatcatcaacgatcagccctcctcgcctctgaacgccgccctggcctacgcccaggtgtatttcctggcgatctggaaggccgcggtgctggcggtgatcctcggttcgctgctgcaagtgctgatcccgcgggactggctgctgcgcctgttcggccgcgccggtttcggctcgactttgcgcggcggcctgttcgccctgccgggcatgatgtgttcctgctgcgccgcgcccgtggcggcgagcatgcgccggcagaatgtctcggtgggcgcggcgctggccttctggatcgccaacccggtgctcaacccggcgaccctggtgttcatgggctttgtcctgggctggggtttcaccgcgctgcggctggtggcgggcatcgtgctggtgctgggggtatcgctggtggcccagcgcatcgcccgtcccgagcaactgccggaagcggcggtggaggccgtggtcgaggccagcacgggcaatgaaggtgcgttcttcagccgctgggcacgcagcctgtggcaactgttctggagcaccattccgatctatgtgctggcggtgctggtgctgggcgcggcgcgggtctggctgttcccccatgtcgagggcgcgattggcgacagcctgctgtggctggtgccactggcgattgtcggcacgctgttcgtgattcccaccgccgcggaaatccccatcgtgcagaccatgatgaccctgggcatgggcaccggcccggcggtggccttgctgatgaccctgccgagcatcagcctgccgtcgcttttgatgctgcgcaaggatttcgatgcgcgggtgctggtaaccgtggccggcctgaccatgctgattggcgtggtatgcgggttgattggcgcggcgttgttgtaacccaaggttcgatggcgtccgcccggacgccatcgcgagcaagctcgctcctacatggttagcgcccccgtaggagcgagcttgctcgcgatggggccaaaggccccgcccgctaccgcctcaaccgcgcttggcgcgctcgcgcaaatattccagcaccgccgcctgctcgccgacgaactcgatgcgcgcgcccttgctttcgcgctggaaggcatacatcggatcgtaatattccttgagcaagccttcgatccaggcccggtgcaggtccacgctgccgctgcgggcctgctcggccagggcggcctccagcagctggtacaggcgctggtgacgctcgccccccaggcgtttgcggatgttgttcaggctttccagcaggcgctcggaaaaccgcgcgaaaccgtcctcgccatgcaccgcgacgaactccgcgcacaggtcgatcacatagtcgcgcaggatccgctcgatccgcccctccaggccatcctccagccagaccatggggaagcgctgcatgccctggtacagcggcaacggcaaggcgcagctgccgatcatgcggttctcgtcttccagcacgaacccgccgatgccacgctcgcgctttttcaggatgtccaccgccaggcggttctcgaagtcgatgttcgacggctggccactggcgcgcttgccgaaactggagccgcgatggttggcgtggccttccaggtccaggccgttggccagttggttgagcacctcggtcttgccgatgccggtcatgccgccgagcaggacaaaatcacactcggccaccgctccttcgagggtgtcaagcaggaaggtacgcatggccttgtagccgccgccgacccgcgggtagtcgatgccggcctcgtccttgagccactgctggacgatctgcgaacgcaggccgccgcggaagcagtacaggtagccatcggggtgggcccgggcgaagtcggcccaggcctggatgcgctcggccttgatcgccccggacaccagctggtgcccgaggacaatcgccgcctgctggccctgctgcttgtagcaggtgccgacccgctgccgctcgtggtcggtcatcagcggcaggttgaccacgccgggaaaggcgcccttggtgaattcgaccggcgcgcgggtatccatcatcggccggtcgttgaggaagatttcgcggtagtcggtgatatcgatgggcatcagatcacctcgaccgcgttgctctgtcgttccaccagctcaccgatcggcgccagttccaggcccagttcggcggccagcgcgaggaaggccgcattgccttccggggtgacggcgatcaacagcccgccgctggtctgcgggtcgcacagcaccagcttgtgcagggcctggatacgcccgagcttgtcggcgtagctgtcgaaattgcgctgggtgccgcccggtatgcagccctggtcgaggtagtactcaacccctggcaggcgcggcacgcgatcgtagtgaatacgcgcggtcaggccgctgccgtcggccatttccaccagatgcccgagcaggccgaaaccggtgacgtcggtcatcgcggtcacgccgtcgagcttgccgaagcggctgccgggcttgttcagggtgcacatccagtcgcgggccaggccgacgtcggcgctgcgcaacttgcccttcttctcggccgtggtcagcacgccgatgcccaggggcttggtcagatacagcaggcaaccggcggtggcggtgtcgttgcgcttcatgtggcgcttttccaccaggccggtcacggccaggccgaagatcggttccggggcgtcgatcgaatggccgccggccagggggatgccggccgcgtcgcacaccgcgcggccgccgcgaatcacctcgcgggcgatttccggcgccagcacgttcactggccagccaaggatggcgatggccatcaaggggtcgccgcccatggcgtaaatgtcgctgatggcattggtcgcggcgatgcgcccgaagtcgaacgggtcgtcgacgatcggcatgaaaaagtcggtggtcgagaccacgccgcgctcttcgtcgatggcgtacaccgccgcgtcgtcgcgcgaggcgttgccgacccagagtttcgggtcgaggttctgcgcgccgctgccggccagaatcacctccaggacctggggagaaatcttgcaaccgcaacccgcgccgtggctgtactgggtcaggcgaatcggctcgctcatggggcacctctggaagtcgtggagcggcgattctagcagagcgacccgagcagaacgtcaagcaccctttccctgcactccagaaccagcatcgaacgcagccagatagtcagcgaatactcgacccgaggcagcgaaggtcgtttgttgctatcacctcgatgattgaacgagggctcatcagccctgtgccaggcaccagcgccttcgccctttcttcgcgcacaacgcccaggcgctgggcaacgtcctgaccgaaaagacagcttatgggtaggtttcgcctttatttcaatcagctacgtcaagttggtacagcatatgcaaacgtttgcgagatcagccttcgagagctttcgccgccagttcggccaggccgggccactcgggcttcagaaccgcacgaacagggattttcaatgcacgtacctttcaccccctccgcgtcccgccacaccttggttgtttccttgctactaagcgccgttacaggactactcagcgctaccgcccaggccgaggaaaaaaccctcgacgactcggcccagggcgagagcttgagccccgccgccacgccggcgaaaccaggcccctacctatcggactggtacaaccaggacctgaccctgatcggcagcaaggacatcagtttcggcccgcagccggccgacgatatctacctggaatacgagtacttcggccgcaaggggccgttcgagctgtacggctacatcgacatcccgaagatcttcaacatcggcaacagccacgacaaaggcgtgtgggaccacggctcgccggtgttcatggagcacgagccgcggatctccatcgactacctggccggacgcagcctggccatcggcccctttaaggagtggtacgtggccttcgactggatctacgaccacggcagcaacagcgccaaccgcgccaataccctgtacagcggcctgggcaccgacatcgacacccattcgcgggtcaacctgtcggctaacttctacgggcgctaccagtgggaaaactatggcgccagcaatgaatattcctgggacggctaccgcgcccagctcaagtacatcgtacccatcgacaaattcagcaacggcgcctcgctgacctatatcggcttcaccaacttcgatttcggctcggacctgcacaaggacaacccggcccgcaccgccaacgccacggtatccaccaacgtattgctgtattcctttacccacctgcggttcaccctggtcggccgctacttccacaacggcggcaactggcaggacggcagcgagctgaatttcggcgatggcgatttccgcgcccgctccaatggctggggttactacgccggcatcggttaccagttctgatcactcaagcaatggaggctttcatgcacgcgataacccgtctttccctttccgtgggcctggcctgcggcgccctgctcgcttcgacggcctgggccgccgaggccccggcgaccccgatcaaacccaaggtgatgctgatcaccatgttcgcccccgaggcccagcactggatcgagcgcctggaactgaaacaggaagtgcgcgtaccggggctgtcggcggagtacccggcgatccgttgcaataccagggacgtctgcctgctggtcaccggcatgggccagaccaacgccgcggcctcgaccctggcactggcgctgtcgccgaaattcgacctgcgcaaaagctacttcctggtcgccgggatcgccggcatcagccctaaacacgggaccatcggcaccaccgcctgggcccattacctggtggaattcggtacccagtgggaactggattcgcgggacgcgcccaaggactggccgaccggctacctgggcatcaataccaaaggcccgaacgagaaaccgccgctggactacaagaccgaagtcttcgaactcaacccgaaactccaggccaaggccttcgccctgtcgcgtcgggtaagcctgagcgaaagcaaggaatcggcagcctggcgcctcaagtacccggcggccccggccaaccagccgccggtggtgacccagtgcgacaccctggcgggcaacacctggttctccggtacgcgcctgagcgagcgggccgaggtctggacccgcctgctgaccgacaacaagggtgagtactgcaccacccagcaggaagacaactcgacctacgaggccctgctgcgcgccagtcgcgaaggccgggtggacgtgcagcggctggcggtggtccgcgccggctccgacttcgaccgccccgagccgggcggcagcgaggtcgacaacctgctcaagtacgccgaccagggcggttttgtcccggccctggaaaacctctatcgcaccggcaacccgctggtgcaggacatcctgaagaactggtcggcgtgggagaaaggcgtgccgggggcgtaaaccaacctgtagccgctgccgcaggctgcgataggtccgcaggacctcagcgaacgctagatcgccgcgccccttcggggcgatcgcagccttcggcagcggctacaacaagccacgccaatcctctgacccgcacaagccccccacccttacggcagcaaaatcaccttctcgccactgccctgattgacctcgtgataacgctcgacgccctgctccagcggcgattcgaacagcccctgcggcaatggcaacagcgcctcatcgaagaaccggccgaactgctcgagcatggccgcgcaggcctgcacgccgtacagcaacgagttgatcccgaccaccgaaccgcccttgcgatacaggcccagggccggcagttgcacatggccgtccaccggcgcggcgatgatggcgatgcggccgaacggcgccagggccgcgaccgaggccggcagccagaaaccggtggtgtcgaagatcacctcggcgccgccggcgaacacctcgttgacctgcgccgcgaggtcttccggctggtccagttgcaaggcctggaacccttgcgcctgcaaggccttgacctgctccgggcgccgcgcggcggccagcaccctggccccgcgaaccttcgccagggccagggcggcgctgcccaccgccccgccgccaatcaccagcaacgtggtgccggcgcttaccccgctgcgttccagggcatcccaggcggtggtgtaaggcacccccaggctggcggcctgggcgaagctcaactgcgccggcttgtgcgccacgcccttggccgacagcgccacgtactgggcatgggagccgtccgcatagaacccctgctccttgccggtgccccagacctcctgccccacccactccggcggcccctctaccaccaccccggcaaagtcccgcccgggaatgcgcggcaaggtggtgtagggaaaacgcccgagcacatttttcacatcgctggggttgaggccggcggccttgatccgcaccagcacctgatcggcggccggcaccggggtcggtacctcgacgtagtgcagcgacgagagatcgccggtcttggaaaattgcagggcgtgcataagcgcctccatgaacaggaatatataaaagaatcgaaaggcctcaggacaaccagctgctcaccagctgccggcccatgggccacagctgttcgccggcgagcatgccgagcagcccgaccagggcgatggccggcggcgccggcgagcgaaaattcagcgcgccataaagcaggccgacgccgagaccgatggccagggagatgaggtaatgcatgacgaactccaggcagtgcgccgcgcctgggcggcggcaagtgggcatgccgggagtctagggaacgccgaaccgggcaaccggccaagcacttcaggatttcggccaatctgtgggtatgaacgagtaagagcgaagcctggctgcgatggccccgacgtggaatgtctggcataccgcgttatcgttcatcgcgagcaagcttcgctcctacgggattgcagcgcacacacaatggatgcctgtacgcaaagccccgtagccgctgccgagccgcgcgaggctgcgatcgactgcgcagcaggcgcaaagcctgagaatgcagtgggtctggataaacgcggtggcccggtcgcagcctcgcagagctcggcagcggctacaaggatgacaggcactcaggcgcgggcttccccggccgcgtattgcgacggggccagccccagctcgcggcggaacatgtcgctgaagctgccgggggaataccccagctcacgggcgatggtgccgaccggcacgccctggatcagctcggcggcggccgtggccagctgcacctggcggcgccactcggcgaagcccatgcccaggccgtccttgaacagccgcgccagggtgcgcacgctggcgcccgccgcctcggcgtggcgttcgaagggaatgtccagcgaaggcgcggccatcaccgcctggcagaggctgatcagacgccggtcggaactgtccggcaggacgatcttcagctgcgagcgccgggcgcgcttgagctccagcagggccaggcccaccagcgcgtcgtagtactccggctgcggcgcgccgtcatgttccaccaggcgcacgatcaactcgcgcagcaggttgtccacctgcaacacctgcacctggctgtcgagggtcgccgccaggcacgggcgcagatagatattgcgcatctgcaggtcggtgaccacgcggatcccgtggggcacgcccggcggcagccacaccgcccgttgcggcggcaccaccagcgcctcgttcggcgtctcgacccacatcaccccgctcatggcatacagcagctgcccccaggcgtgttcgtggggctcgatgaacaggccgcgcggataggtgcgcgccaggggttgcaccggtacgtcggtgtcgctgaggtcgggaggtgcggcaagggccatggccgggcatcgtcgtcaagcaaggggggcccatggtaaccccgtcgatccgcctggaaaaccgcgagaaaacatccgaacgggcgccgcagcgacaggcaataacccgttcgaatgcctgcccgaccactacccgaccgctgatacccttgctcgacaatccgagtgaatttttccctgcccgcgcgggtcactaaaccatcacagggaggattgatagctctatgaacaacgcaaaacttttcgtcatcgaatacaccctgcacggcacccccaagtccttcatcatccgctcggagaagatggacaacgccgaggcgtggcactgggcaagctgcgacgccggtgtcggccgcatcggccgctttggcctggaacgggtgaaaaagaccagcaagcccctggcggaaaaattcggtatcgagaacgtcacctggcgaccgtcgacctgagccaagcgaggtcgatgccttgcggcgtgcgctgccaaagccgccggccagccgccttgccagcgaaagcggtatctgcaccccgcacaattgaaagtggagccacgacaggctccactgttttttttcgccccgccactgttgcagcacgtcagtgatgcgcgcccttggcgcaatcacagcctttggtagaggcgcagggttcgccgttggcgtggtggctggcgcaggcctggcagcagtagtgcttgccgtgacgcacaatggcatgggcgccgaccttgcaggtgcagcctggacaggcacaagtctcgttggacatggggtgactcctttgtggtggtcgtcgacgacgcggatgttgccgcgtctctagcagtgtagtggctgcccgtcgccgccattggcccctggtcgcggcggcttcagttccagccttccaggcgcaaggtcgcccgcaccaggcgctgctcttcgttttcgatctcccgcaggttgtcgcagaggccctggatatgcgcgatggcggccttgcgcgcctgctccggcaggcggccggtgacggcgttgtagagccgcgcgtgctggcggtcgatctggcgcttctgcgcctggcggtggtagaggttgttgaccgaggcgaacaccgaattgagcagcaggtcggtcagcgagcgcagggtctgcaccagcaccgggttgtgcgaagcctcgcagatcgccaggtggaaagcgtgatccaggcgcgcgtgggccgaggcatcaaggacctggtcgtgggcgtccagcagcgcctgataggcgcggccgatcagcacgaaatcggcctcggtgccgcgcaacgccgccagccgcgccgactcgccttccagcaggctgcgcacttcgaacaggtcgtagagggtgcgcggctgggagctgaacagatgcatcagcgccgaggtcgcgccctgtcccgacagttgggcgacaaacgagcccttaccctgttcggtttcgatgatgccccgcgcccgcagcagcttcaggccctcgcgcaaagccgtgcgcgatacgccgagtttttccgtgaggcgccgctccgagggcagcagctggccggtcttgagcacgccgtcgacgatcaggcgctcgatgcgttcacacaccacatccgccacctggtgccgagtcgaatccttgctgtgcatgcgtcctccactggtatgaccagccgtgaagaaaaaacccgatcaaacggatcgccaggccatcctgctgatatgcctggctttttataaaaaacccggcatcgacggcaaaacaaactggttcgaccagcgttcggccccgtggacagtaaggccagccgggccaatgatgcaactgagcggcctgcccctgccggccgcctaataaaaacaactcagggtcgtcagccacccatgaatatcctctacgacgaacgcgtcgacggcgcgctgcccagcgtcgataaagcggcattgctccaagcgctgcgccagcgcctgcccgacctcgacctgctgcaccagacggaagacctcaagccctacgaatgcgacggcctctcggcctatcgcaccacgccgatgctggtggccctgccgcggcatatcgagcaggtgcaggaactgctgcggatctgccatgaacggcgcgtgccggtggtcgcccggggggccggcaccggcctctccggtggcgccctgcccctggaacagggcgtgctgctggtgatggcgcgcttcaaccagatcctgcatatcgaccccgccgcccgcaccgcgcgggtccagcccggggtgcgcaacctggcgatctcccaggccgccgcgccgttcggcctgtactacgctcccgatccgtcctcgcagatcgcctgctcgatcggcggcaacgtcgcggaaaacgccggcggcgtgcattgcctgaaatacggcctgaccgtgcacaacctgctcaaggtggagatcctcagcgtcgaaggcgaacgcctgaccctgggtagcgacgccttggacgcgccaggcttcgacctgctggcgctgttcaccggctccgaaggcctgctcgggatcatcaccgaagtcacggtcaagctgctgcccaagccgcaactggccaaggtgctgctggcggccttcgactcggtggaaaaagccggccgtgcggtggccgatatcatcgccgccggcatcatccccggcggcctggaaatgatggacaacctggcgctccgcgccgccgaggacttcattcacgccggttacccggtggacgccgaggccatcctgctgtgcgaactggacggtgtcgaagccgatgtccacgacgattgcgaccgggtccgcgcggtgctcgaacgggccggcgccaccgaggtccgccaggcccgcgacgaagccgaacgggtgcgtttctgggccgggcgcaagaacgccttcccggcggtaggccggctgtcgccggactactactgcatggacggcaccattccgcgccgcgcactgccgggggtgctcaaggccatcgccgcgctggccgccgaataccagctgcgggtggccaatgtgttccatgccggcgacggcaatatgcacccgttgatcctgttcgacaccaaccagcccggcgaactggaccgcgccgaagccctgggcggcaggatcctcgaactgtgcgtggcggtcggcggcagcatcaccggcgaacacggggtcggccgggagaaaatcaaccagatgtgcgcccagttcaacagcgacgagctgaccctgttccacgcggtcaaggcggccttcgaccccggcggcctgctcaaccccggcaagaacatcccgaccctgcaccgctgcgccgaattcggcgccatgcatgtgcacgccggacaattgcccttccccgagctggagcgtttctgatgacggcacacgcggataacgacgccagcggcgaactgctggaacaggtcgggcaggcgctggccggcaataccccgctgctgatccagggcggcaacagcaaggcctttctcgggcgcatgagcgccggtgaagtgctcgacacccgcggccatcgcggcatcgtcagctacgaccccaccgagctggtggtgacggtccgcgccggcacgccgcttgcggaactgctggccacgctggacgccgccgggcagatgctggcctgcgaaccgccggccttcggcgacggcgccacggtcggcggcatggtcgccaccggcttgtccggcccgcggcggccctgggccggctcggtgcgcgacttcgtcctcggcagccgggtgatcaccggcaccggcaagctgttgcgctttggcggcgaggtgatgaaaaacgtcgccggctacgacctctcgcgcttgctggtgggcagctacggttgcctgggagtgctcaccgaggtgtcgctcaaggtcctgcccaaaccgcgccagtgcctcagcctgagcctggaaatggacagcgccaaggccctggcccgcctcgccgactggggccagcaaccgctgcccatcagcgccgccagccatgacggccagcgcctgcacctgcgcctggagggcggcgaaggttcggtggctgcggcccgcgaccgcctgggtggcgagccgttggccgccgattactgggccaacctcaacgaacaacgcctggcattcttcgacgaaggcctgccgttgtggcgcctgtcgctgcccaataacacgggacttctggagctgcccggccagcagttaatagattgggccggggcccagcgctggctgaaatccgcggcgcccgcggagcgcatccgcgacctcgccagccgcgtcggcggccatgccacctgctacagccacggcctggtggacagcccgttccagccgctgccggcggtgctgctgcgctaccaccgccagctcaaggcgcaactggacccgcaagggatcttcaaccccggccggctctacgccgagctctgaacgcagaccccgagcatgcaaaccaccttgagcgaacaggcgcgccagctgccccgcgccgcggaggccgagagcatcctgcgcacctgtgtgcactgcggtttctgcaacgccacctgccccacctatcagttgctgggcgatgagctggacggaccgcgggggcgcatctacctgatcaagcaggtcctggaaggccacgaggccacggccaagacccagctgcacctggaccgctgcctgtcgtgccgcaactgcgaaaccacctgcccgtccggggtggattaccacaacctgctggacatcggccgcgccgtggtcgatgccgccgtgccccggcccctcggccagcgcctgctgcgccagggcctgcgcgccctggtgccgaacccggcactgttcaaggcgctgctcagcaccggcgccaccttgcgtccgtggctgcccgaggccgtgcaaggcaagctgccgcgccaggtgcagccggccaagacacgcccggccacggcccacgcgcggcgtgtcttgctgctggaaggctgcgtgcaagcgagcctgtcgcccaacaccaatgcggcgacggcgcgggtcctcgaccgtctgggcatcgccgtgcaaaccgtgagcgaggccggctgctgtggcgccgtggattaccacctggacgcccaagaggccggcctggagcgggcgcggcgcaatatcgacgcctggtggccgcacctggaaaacggcgccgaagccctggtgcagaccgccagcggctgcggcgcctttatcaaggattacggccacctgctggcccacgacccgcggtatgccgcccgcgccgagcgggtcagcgccctggccagggacctggtggaagtgctgcgcgacgaaccgctggaacagttgcacgcccacagcgaccagcgcctggccttccactgcccgtgcagcctgcagcacgcgcagaaactcggcggcgcggtggaggccgtgctcaagcgcctgggcttcgagctcaccgaggtgcccgacggccacctgtgctgcggttcggcgggcacctactcgctgacccagcccgagctggcgcggcaactgcgcgacaacaagctcaatgccctggaaagcggccggcccgaagtcatagccaccgccaatatcggctgccagacccacctcgacggcgccgggcgtaccccggtgcggcactggatcgaactggtcgaggccgccctgccccccctgaatgcttcccatcaatcagctacgccctgaaaggagcacgccatgcacagcaaagccgtactgggtcagcgcgaagtccagcgcatcctgatcgccgcgcgggacgaggccgagcgcaaccaatgggcggtgagcatcgccatcgtcgacgacggcggccatccgctggccctcgaacgcctggacggctgcgctccggtcagcgcctacatcgccgtggaaaaggcccgcaccgcggccctcggccgacgcgagtccaagggctatgaagaaatggtcaacggcggacgcacggcgtttctctcggcgcccctactgacttcgctggaaggcggcgtgccggtggtgttcgacggccaggtgatcggcgcggtcggggtgtccggggtcaagtccggggaggatgcccaggtggcgcggttcgctgcccaggcactggattgaaaatctggaccgctgcgcggtccatcgcgagcaagctcgctcctacagggttctgcgccgtccatgtaggagcgagcttgctcgcgatagggccggaaaatccgccgccccgacgcctgcctcacatcaccaactgcgcaatcagccaggcgttggcgccgctgataacggcgaacaggctccaggcgaggatgcgggtcggccagcggttgacgaacacgcccatcaactgcgggtcgctggtcatacggatcagcgggtagagggcgaacggcagttgcaggctgagcaccacctggctcagcaccagcagctggccgaccgcgccgtcgcccatcagccacacgccgacgaacgccggcaccagcgccaggccgcgggtgatcaggcgccgctgccagcacggcaggcgcaggttcaggtagccctccatgatcacctggccggcgatggtgccggtgaaggtcgagctctgccccgaggccagcaaggccacgccgaacagcacgctggccagcgccccgcccaccagcggatcgagcaggtgataggcgtcctgcagctccaccacctcggtgtgcccggtgccatggaaggccgcggcggcgaggatcaggatcgccgcgttgaccagcagcgccagggccagggagccgatggtgtcgatgcgcgccagcttgatcgcatcccgccggctggcctcgtcccggcccaccaggcgggtctgcacgatggaggtgtgcagatacaggttatgcggcatcacggtggcgccgaggataccgatcgccaggtacagcggcgcggcctcgccgatcgctgccagcgacggcgtgaagccccgcgccacgtccggccagtagggtttgatcaacagcagctcgacgaaaaagcacaggccgatggtgcccaccagcaccagcatgatcgcctccaggcggcggaagccacggttctgcagggcgagaatcaacagggtgtcgaaggcggtgatgacaatcccggtggtcagcgaaaccccgagcaacaagtggaacgccaaggcgcaccccaggacctcggcaaggtcggtggcgatgatcgacacctccgccagcagccactgggtgcgcgccgtgcgggtgctgtagcgctgccggcaaagctgcgccaggtcacgcccggtggcgatgcccaggcgcgagcacaggcattgcaccgccatgcccgcgaggctcgccagcagcaccacgaacagcaggttgtagccatagcgcgaaccggcctcgatggcggtggcccagttgcccgggtccatgtagccgatggaaatcaacaggccggggccggcgaagcgcagaatgcgcttgaacagcggcgcgctgggatcgacgacgatggtgccggcgacttccggcgggcaaaagggtgcggtaccgactttggggagagtgaatttcacgcgggcatccggaaggctggaacggtggcccagcttagacgtttcagcgaaccggcccaagccttgatagcgccctgccccggccttttgcagccttgcttctgtaggagcggagcttgtcgcgatagcggcatatcagtcaccacaacagatgagccggccccttttcccaaaccatcccgcaccgaccgaccgctcctacagcccccgtattttcaggcatgatgcgaggcagccatccgcggagcagcaccatgaacactccagcccaacccactgtcgccctggcgatgcgttcgtattccgggcaggtcgagctgcatcatcacgattttccgcagatcgtgctgccgcagtcaggggcgatggagatcgaggtggatggccgcggcggcaaggtcgacgccagccagggcgtggtgattgcgccgggcgcccggcatagcttcctggccgagcgccgcaatacctttctggtactcgacctggatagccccgacaccgaacaatctctggccgatacccgcttcttcgccatcgacccgcagatccgccacctgctcggctatgccagccacagcagtgccttgctcacctcttccagcccggtcgccagcgcctggagcgccctgctgctggcctgcctggcccgcccgacgccgagcgcgccgcagcgccagacgctggtgcgggccctgacctacatcgagcaacacctgggcagcccgctgagcgcccgcgccatcgcccaggccgcgggggtcagcgagcgcagcctgtacctgctgttcgagcgggacatgcacagcacgcctttcgcctacatttcgaccctgcgcctggaccgcgccatcgacttgctcggccgcaccctgttgcccatcagcgagatcgcccagcgggtcggctacgccgatcagagtgccctgacccatgcgttgaagaaggcgcgcaaccagaccccggccgccctgcgcaaggccgctcgcgacgcccaggcgcaggctgcgacaagagttcggcaggcctgatcaataccgccgtcgcggcggcttctatgctggccacaccgcccttgcctcggtgtgcctatgaccgccatccactcaacccgcctcgccccctcccgcagcggcgccgccaccgccatcggcgtgatcgcggtgttcctctggtcatgcctggcgctgctgaccaccctcaccgccggcattccccccttccagttgctggccctgagctttgccgtggcctgcggcgccagcctggtattgctcggcttgcggggacgcgccggctttcgtggctggcaccagccctggccggtctgggccctggggttcggcgggatctttgcctaccacgcgctgtatttcttcgccctgaaagccgcgccggccgccgaggccagcctgatcgcctacctctggccgttgctgatcgtcctgctggcggcccgggccggcggcgaaccgctgcgcggccggcaactgaccggcgccttgctggggctggccggcaccgcattcatcatgcagcagcgcgctgccagccaggtcggcgcgatgccggtggcgggttacctggcggcattcggctgcgccctggtgtggtccggctactcggtgctcaaccgccgtttcagcagcgtgcccagcagcctgatcggcggcatctgcgggctggtggcgctggccggggcgctctgccacctgatgttcgacagcccggtgcaaccggacctcaagcaatggctggcgatcatcggcctggggctgggtccggtcggcctggccttcttcgcctgggaccacgccaccaaacacggcaacctggccacgctcggcgtgctgtcgtacctggcgccgctgatctccaccctgttgctgatcgtcatcgggcaaagcccggccagtgtatggctgctggtgccggcgctgctgatcatcgccggggcggtgctggcgacttcgggggcccgctctgcccagggcgacgagcaaaaactgtcacaccgataagcgccacgaaggcgctcccgcgcccttttatccgaaatttcgcgccaccgcacatcccgctggagtgccccgcgacagccgtgggaagatgcgcgccccaacgcgctcactctggagaatctgcatgtccctgttcggtaaacacgccgcggtcctggtcctggcggcgctggccggcttcagcgccctggaggtgtccgcggcccagccgacgaacaacaaggccaaggtcgagaccgtctcgatgctcggcggcaagttcaagttcagcctgcccaagggctttatcgccaacccgttgccggccggcgacgaagccagcggcaccgccggcgccaccggcactatgtacaccaacgccagcaccaagaccgtggtcatcgccgcacagaacctgatccccgatgcggtgcaggccaaggacaacgacgcacagttcctcgacagcgcggtgtcgggtttcctctcgcaacaggcggcagccctgccggacttcagcaagcagagcgaaaaaagcatgacccgcggcggcctcggtctgcgccagatcgacagcaccgcgacccagggcggcggcatgacccagagctccaccctgctggccggctcgggtaaccgcatggcggtggtgcaggtgatttcgcggatcggcgacaaggccaatcacgacaagctggtcagccagatcgtcggcaagtaagcgcagcggcagagcggccgcggcgggttcacggcttcaagggttgaggctgagcaaccagcggttcaggtcctggagctcggtgtcgctgatggtgtgaccgatgcccgggtaggcatggaattgcggagccaggcccaggccgcgcaacaggctgtcggcctcggagccgtcgctgtaaggcaggcgcatatccgcggtgccatgggcgatgaagatcgccagccgctccaggcccgcgccgctcttgagccgcgagcgcagcaccggcaggatcttcccgctcagggcggcgatcccacggaccgcctggggatggcgcaggcccagctcgtaggccatgatcgcgccctggctgaagcccaccaggaacacccggtcggcgcgggtgtggtacttggcgagcgcctgctggacgaactcgtcgatcagcttggcactgtcggccaactcggcggttaccccgtcgtaagcgccttcgccctgcttgtgaaaccactggtaactgccctcttcaactgtctgcggcgcccgtaccgagaggtaggtgtaatccgccggcaacccgtccttgaggccgaacaggtcttcttcgttgctgccgtagccgtggagaaaaatcaccaaaggccggtcgcgggaatcggccgcggcctgttccaggtagagcagcggcaggtcgtcgtgcagcaccgtctgcgcctgggcagtggcgcaaacacttagcagtaacagggccaggaacttgaacatgggacgtccttgcgggtgagaggggctcgcggtcaccaagggcaaaagcgttgcctggtggtctggccgcggagcggccatcgcgagccagctcgctcctattagtgaggagcagtgaggagcggtgaggagcggttctctcaatcgttggtcagcttgccgctgcggatcggctcgcggccggcgaccttggcctgccagatgcccggctcggtgtagcggctgcggtccagggcgaacagcacgccgctggtggcggcgcgcaccacgctgacgatgtcgttcagcggatcgaccacctcgaagatcgcatcgccccgctccacccattcgccagcctcacgcaggaagctgaccaccccatggtgcggggcgaacaggtattgggtgccttcgaacggcatgccctcgcagcaggcatccggggtcgccggccattggccgtcgataaacccctgctcggcgagaaaaccgaggatcgcttcgcagttggcctgggcctgttcgacccgggtgtcgcccatgctgcccagctccagggtggtggcgaggttggccgggggaatcgccgcccgcgggaagtcgcgggccaggcgcagccagggcgtggagcaggattcgtcgaacgaactgccgccggagtcttcgcagagcagcgccacgccggccttcagccgcgcggccagggattgccagcgtggccagtgctgaggcaatgcgtagaggtggatcgccgcttcgaaatcgcaatgcaggtcgagggtgatgtcggcgtcgcaggcatggcgcaacagcaggcgttgcagggcctggagctgcgaggtcggggctggcagagcgtcgaggacgtcgcccatggtctggcggatcaaggcgacgttggccgccgcatcgctgcccaggcggtcaccgatcaggtcgcccaccgggccgctgagctcgacgaaggcgcggttgaagttcttcccgctgccgctttcaaaccgccccaggtggctgctttgcaaatgctggtcgaggccgatggggttggccgccggcaccagctcgatcacgcccttgagttgcccctgggcttccagttcgctcaggcgttttttcagttcccaggcggtgcgcatgcccggcaactcgtcggcgtgcaggctggcctggatatagaccttgcggctgccgccgccaaaacggaacacgctgagctggcgctgggtgcccaggtggctccagggcagggaatggtcgatgcgttgcatgaagggctccggaagaaaaatggagttcggcgggggccgtagcctgaggcatttgcgcggccgtgaaaaggtcgtcgtccgctgccgggtggcgcgggcttctgtagccgctgccgcaggctgcgataaggccgaaggccttcagcgatctcaaggtccctgcgccccctgcggggtcgatcgcagcctcgcgggctcggcagcggctacaggagcgccccatcgcacgggggaaaatcgcactcatgaaaaaggcggccccggtaaacggtagccaccttcttcagcgcagcagcgaattactcgccgtagacgtcgaacttgaagtacttgtcctgcacggccttgtacttgccgttggcgcggatctcagtaatggcggtgttgaatttctcggccagggcggtatcgcccttgcgcacggcgatgccggcgccgccaccgaagtacttcggatcgttgtactcgggaccgacgaaggcgaagcccttgccggcgtcggttttcaggaagccgtcgtcgaggttgaccgagtcggccagcagcgcgtcgatgcgaccggaaaccatgtccaggttggcttcctgctgggagccgtaacgcaccaggttgatcccggccggcaccagcacttcggtggcgaaacggtcatgggtactggcgcgcagcaccccgactttcttgcccttgagttcggtcagcgggtccttgacctcggtaccttccttcatcacgaagcgcgccggggtgtggtagtacttgatggtgaagtcgacgtttttcttgcgatcgtcggtgatggtcatggacgacaggatggcgtcgatcttgcgcactttcagcgccgggatcaggccgtcgaattcctgctcgacccaggtgcatttgacgttcatctgctcgcacagcgcgtcgccgatatccacgtcgaaaccggtgagcttgccgtcgggggttttcatcgagaatggcgggtagccggcttcgataccgatgcggatcggcttggcatcgtcagccacggcggtcagggacagcatggacagtgccagggcaccgaacagtacaagcttcttcatttataactcccgtagacggaggctcttattggcagaaaggttcgattgggggaaatcgaagtggccagcagtctagagcggcgcccgggaggcaaattgtgtttatgcgacaaatatttatataaaaacccgagaaatccaggcatcgaccgagcggccccacacaagtgcgaggcccctggaaaatgccctcgatcccggcatttttccgcgttccagcgcctgagtcgcgactcgccagtcgccgccggaacgccttgcaaggccttaatcatcctagatacgagcgggccgcggtatttcagccaggcccggtacagcggttttgcgaggacgacgtcctcgatcgcagcctcgcgggctcggcagcggctacacgcacaacgccaactgtagccgctgtcgagtgccagcgaggctgcgaacgggcgcgaagcgaccgccaatcaggcaccacggtgactcagcaggcgcactccgccaccacgctcgccggccgctccagctcgacgctgagggcaaagccctcatccagccagccagtcacgccgccgatcatctccttgaccgggtaacccagggccgccagcctgaccgcggccttattggcgccgttgcagtgcgggccggcgcaatagaccacgaacagggtgtcgcgggagtagcccgccaggcgctcggcgttgatcagccgcccaggcagattgaccgcccccggcacatggccgcgctcgaacgccagcggtccgcgcacatccagcaggacgaagtcgacctccccggcttcctggctgccaaagacgtccgagcaatcggtctcgaaggtcaggcggttggaaaaatgcatcagggcgatggccgagggggcggcgggaacttcacgaaccaggctggtcattgcggcgtctccagaacaacagtgggtgtggcgagactttatcgacacgagcgacgccgctacagtggcgcacaagactctgactggtaacttcccgccaaatgcataacgcccccggtttagtcgcgatcctggcctacaacggcctctgcaccttcgagttcggcatcgccgtggagatcttcggcctggcccgcccggagttcgatttcccctggtacgaacaccgcatcgtcgccgtcgagcccgggccgctacgggccatgggcggtatccaggtgctggccgatggcggcatggagctgctggaacaggcgcggaccatcgtcatccccggctggcgcaaccgcaacgagccgctgccgcccgggctgagcgaggctttggtgcgcgcccatgagcgcggcgcgcggctgctgtcgatctgctccggggtattcgccctggcggccaccgggctgctggacggccggggcgccaccacccactggcaatacaccgatgaactggccgagcgtttccccgccattttggtggacccggacgtgctctatgtggattcggggcagatcatcacctcggctggcagcgccgccgggatcgacgcctgcctgcacctggtgagccgcgacttcggcacccacgtcaccaactcggtggcgcggcgcctggtgatgtcgccgcaacgcaccggcggccaggcgcagttcattccggcaccggtcagccgcacgccgcgcaacgacctgtcgcgggtcatgcattgggcccgcgaacacctgcatgagccactggaagtgcgcgacctggccagccaggcgttgatgagcgagcgcaccttcctgcgccgcttcaaccaggccaccggcgtctcgcccaaggcctggctgcagcacgaacgcctggcccgggcgcgggagttgctggagagcggcagcgagcacaccgaaaccatcgccctgcgctgcggctaccgctcggtggagagttttcgcgtggcctttcgcagcgtggtgggcctgccgccgtcggcgtaccgcgaacggttcgggcgtggggagaaagtggtcgccgagtgatgggccgagcgggagaacgtcatcgcgggcaagtcggatcgccgcccgctcactcctgcagaagcagcttcccgctttcctcaatcctcgggcttgcgcagcaggtaggtgtccatgatccagccattggcctgccgcgccgccttgcgcacttgctggatctgccccgcgacctccttgagccggccggcaatcaggatttcctccggcgtgccgaggtaggcgccccagtagatctccaggtcctggtccgccacctggcgataggagtcctcggcgtcgagcatcaccaccaggctgtcggcatcgctcacctgccccgccgccagtcgccggccggtggtgatctccactgagcggccgatgcggttcaacggcaccttgtgctgcgccgccagggcctggacgctggtgatgccggggatcacctcgaactcgaacgcacagcggccgctggccaggatcgcctgcaggatgcgaatggtgctgtcgtacagcgccggatcgccccaggccaggaaagccccggtttcaccgtccgccagttcctcatcgatcagccgctcaaaggtgcgctgcttgtcgcggttcagctcggcgacgctggcctggtaatccacctcggcgccgcgcagtcgctccgggctttgcgcttcgacaaaacggtagccgggccgctcgatgtagcgctcgcagatttcccggcgcaggtcgatcagcgcgtccttgctctggcccttgtccatcaggaagaacacgtcggtgcgattgagcgccttgaccgcctgcatcgtgatgtagtcggggttgccggcgccgatgccgatgatcaggagggttttcacgaggggcaggtctcgatggcgaatcggaaatggagtatggccgggttgtcgcggcgcgtcacaaagcggccgccgggcggcctatcgcgagcaagctcgctcttacaaggggttgcactgtctttgtaggagcgagcttgttcgcgaaaaaatccccaggccacgccgagccaagcccgctaatcgcgctggtccaggcgcaagcgccagcgcccgttgaagcgcagctcgacctgggccagcggctcgacatcgatggcattgaagctcgccagcgggcactgcatgacgtgcaccagcgccgcgcggatgaccagcggatgggtcaccgccagcacatgcccgggctgctcgctcagcgctgccagccaggccgcgacccgctcgcacagctgcgccaccgactcgccgccatggggcgccaagtggctgtcggccagccaggcttgcagggcctcgggctgctcgcgctgcagatcgtcaatggacaggccctgccagcggcccatgtcacagtcgcgcaacgccgccaccgtctccacgctggcgccatacaaggcagcggtctgccgcgcccgttgctccggcccgctgagcaggcgcggcgcacgcttgaacgcgccggcccgcgagcccgccagcgcctgccaatccatctccagcggttcgtccagcgggaaacacgcgcgcttctgggcgacggtccgggcatggcagatcagggtcaagcgggtggccggcacggggaatctctcgacgttgaatggacgcagcgggcaatgtggctgcgtttgtatcatgggccgccgagggattcccaccttgtcgcagccgaacctaggcgctggcgatccccggccgggccaggtacagcacctcgtagcgttcggcgccgcgcgcgctgtcgggcgcgctggtcgaaagggtgaagcgcaccagctcccaggcctgcaggtcgagggcgacgaacacggcgaaggtgtccgggtcatcggccagccgctggttgtgttcgacctgctcggccagcaacctggcgcgatccgccagcggatcgatcgccagcggctcgcggtacagcgtccgtgcctggttggcacgcccgcgacgccagtccagtggcaaccaggactcgatgtgcgggcggccgaaggagtcgatcacgctgtcgaaaccgccgcccatgagaaaccgggcggcgcccgccggatcggcccagaggtagatcgaggcgtacaggttatgccgcgccccgtgcacgccccgctcctgcccggcgaagaccttgaacagcaaaccgtcgacctcgtcccacaagggcccgcgatccgcggcgcggtggcggatcacgcccatgtcgtaatcggcgggcaggcggtgtgaatattgtttggccaacatggcgatgctcctgtgcttgaaggtgtggccagcttgcgcagggccagccattacaacaagatatcggtacatatatctgcgataagcattcgatatgagcgaacccgtcaagccgttggacatcgacaccgtgcacgccttcgtgctgatcgccgacttcggcagtttcacccgcgccgcccaggcgctggacacctcccaggccgccatcagcctcaagctcaagcgcctggaggaacgcctcggctatcgcctgttggagcgcacgccccggcatgtgcgcctgacaccggtcggcgagcaattcatgcaggccgcccgcgacctgctgcgcgcccatgagcgggccctgggcgatatgcaggcggcgccggctcggcggctgatcatcggcatcagcgaccacgtggccggcgcggaactgccgcacctgctgagtcgcatcgctgcctacgatccgctgctgatcatcgaggtgcgcatcgcctcctcccgggacctgacggcggccttcgaccgcgaggagctggacgcggtcatcgtgcgcaacgaaggcgcgcgccaggatggcgaagtgctggtggccgagcgcttcggctggttcgccgcgccggcctggcagcaggcgccgggcaccccgctgcggctggcgaccatggccgcgccctgtggcgtgcggcatgtcgccgtgcgggtgctggacgacgccggcattgcctggaccgaggtctttatcggcggtggcgtgatggccgtgtgcgccgcggtcagcgccgggctcggggtcgcggcgctggcccatcgggtggcgccggccggcgcagtggaagtcggcgaacgcctcgggctgccggtactgccggtcagtgaaatcatcttgctcgcgcggcccaccgatgcccgctccgaggaaaccctgcgcgccctcagcgccgcctttcgcggcaccctgccgcgctgacggcgtgcctcaaaaaacctcgaacacccaataaaccggggctttcacgcccccttttggcgcattgcagggcgcctttatttttcactggacatgtagcgtaaattacataaatactgttttcactttcagtgaaacaaaaacgacatccacttgcgaaggcgtttttatgccgtctctcagagaccagatcaccgacccggccctcgacctcacgccttcggagcgcaaggtcatccgggccctgctcgaccattacccgcgcaacggcctggggcccatgtcgcggttggccgaacacgccggcgtcagcgatccgaccatcgtgcggctggtgaaaaaactcggtttcggcggttatgcgcagttccaggaagcgctgctcagcgacatggacgctcgcctgcgttcgcccagcaccctgttgcaaccgcgggcccaggtccctcgggacgatgcctggagccattacctgcaaggcagcctgcgcagcctggaacagacccaggccctgacccagcccgaagacgtgcgcatcctggtcgactggctgctggacagccggcacgcgctgtactgctacggcgggcgcttcagcagctttctcgccagctacctgctcaatcacctgcgcctgatgcgtcccggctgcgttgccctggacgacaacgcgcaactgcccgaccgcctgtatgacgtgcagcgccaggacatcgtcctgctgttcgactaccgccgctaccagagccaggccctgcgcgtggccagcgcggccaaggcgcggcacgcgcgggtggtgctgttcaccgacatctacgcctcgcccctgcgggagctggcggacctgatcatcagtgccccggtggagtcggcctcggccttcgacaccctggtgccggcgctggcccaggtcgaggcgctggtcgccagcctgaccctgcgcagcaccgacctggaccgacgcctggagggcatcgacgccctgcgcaacgaattcgccactcacctgctggaggacaaataaggatggtctgccttccccaccaatcgccccgcgacctgccattcactctcgatcgcaccgccctgctgctggtggacatgcaacgggcctggctcgagccgcagctggatccgcatttgcaggtgccggacgccgagtacttcatcaagcgcacccgcgagcaggtgattcccaaccagcagaagctcctggcggccatgcgcggcgcccggcagaacgtgctgcacaccattatcgaaagcctgaccgccgatggccgcgaccgctcgctggaccacaagctgtcggacatgcacctgcccaagggcagcccgcaggcggcgatcatcgatccgctcgcggcgcgggagaacgaaatcgtcctgcccaagacctcctccggggtcttcaactcgaccaacatcgactacgtgctgcgcaacctgcagacccgccacctgatcgtcgccggcatcgtcaccgaccagtgcgtcgacatggcggtgcgcgacgccgccgaccgcggttacctggtgaccctggtggaagacgcctgcgccacctacaccgacgtccggcaccaggcctgcctgaacgcgatcaagggctactgctggatcaccgacacccagaccgtgctcgaccgcctgcgggagatgcaggcatgagccgcaacagcgagccgttgcggccggtggccatgaccaccctgctcaccaccgacctgatcggcgtcagccgtggccgctcgttccccagcgacgaactggacagctacaccagcgccggctgcggctgggtgccggccaacagcgcgctgaccccgcaggacatcattgccgagcccaacccctggggcgcccgtggcgacctgcggctgatccccgacctggccagccgggtgtatgtcggcaacggcccggacgccagcgcctcgccgctggacttcatccacgccgacatccgcgagaccgacggccagccctgggccgcctgcccgcgcaccctgctgcgcaacgaggtgcagcgctacgccagcgagctggggctgcaggtcaccgccgccttcgagcacgaattcaacctgcacagcgccaccgcgcaaccggagcgcctggccttctccctgcaggcccagcgccagggtgcggacttcggcggctggctgctcagcgccttgcgcgccgcgggcgtcgagccggaaatgttcctgcccgaatacggcaagcaccagtacgaaatcacctgccgcccgacccagggcgtggccgccgccgaccgcgcggtgaacgtgcgcgagatcacccgcgagatcgcccggcaactcggccatggcctgagctttgcgcccaagaccgcggagcacgcggtgtgcaatggcgtgcacctgcacctgagcctgcaggacctggatggcacgccggtgctgtacgacccgcagagcgccaatggcctgtcgcacctcggcgagtgctgggccgccggggtgctcaagtacctgccggcgctctgcgcctttaccgcgccgacgccgatttcctacgcacgcttgcagccccatcactggagcgcctcctacgcctgcctgggccagcgcaaccgcgaagcctcgctgcgcatctgccccaccgtgagcatcggcggcaagcccgtggcgccgcagtacaacctggaattccgcgcgctggacgccaccgcctcgccgcacctggccatggccgcggtgctgatcgccggacgcctgggtatcgaacagcagttgcccctgcgcgccgtgaccgacgaagtgccggacgaactgagcgcagagcagcgccaggaccgcggcatcgtcgcccttccggcctcgttgccgcaggcactggactgcctgcgcaactgcccggaactgctgcaagccctgccagccccgctgctggaaacctatttcgccgtcaaacacaaggaagtagaactgaccgaacacctgacccctgcccaactctgtgagcactatgcacacctgtactgaaaccgctgaactggggctgtacacccgaccggcctaccagctgctgcgagaagattccgcgcacccgctgatcctcgtctgcgaacacgccagccgttatattccggcgcaactcaacgacctcggcctggacccggaagcggcgcgcgaacacatcgcctgggaccccggcgccctggagctggcgcaaagcctgtcgcagaccctcggcgccaccctgctgacggccaattattcgcggctgctgatcgacctcaaccgcccgtgccaggcccacgacagcattccgttgcagagcgagatctaccagatcccgggcaaccagtacctcgacgaagccacccgcgagtaccgccgcaagcagctgttcaggccctttcatgcgcgcctgagcgggctgatcgacgcacgcctggccgcgggccggccggtgcgggtggtgggcatccacagttttaccccactgtattacggccagcgccgtacgctggagatgggcgtgctgttcgaccgcgccgagggttacgcccggcgcctgctggaaggcatgtcggtccacgacgtgaagatcgccggcaacgagccgtacaagatcgacgccctgggcgacatgaccgtgccggcccacggcgatgcccgcgggctggattcggtattgatcgaggtgcgcaacgacctgctgcgcaccccgcaggccatacagtgctggacggattatctggcaccgctgttgtaaaaaaagctgtgcatcaggatggagctgtcgttgtaaaaaagctgtttgctgtaccggtacaacaactataaaaaaccgccgtggcgtgtctttaaacctgccaggttcaaatacattgcctgcccctgcaggtcgtccttcgacctcagcgacaggctcccgccccccctttggctgacaaggagaacctcttcatggagattgaagaattcggctacaaacaggaactcaagcgcggcctgacgctgcgcgacctggtggtctacgggatgattttcatgatccccatcgccccgttcggggtctacggctatgtgaaccaggaagcaccgggcatggtgccgctggcctacatcatcggcatgctggcgatgcttttcaccgccctcagctacggcagcatggcccgcgcctttcccatcgccggctcggtctattcctacgcccagcgcgggctcaacccccatgtcggcttcatcgccggctggctgatgctgctcgactacctgctgattccgccgttgctgtacgtctacgcagccatggcgctgaaccacctgtacccggacattcccaaggtcggcttcatcctcgcgttcctggtcagcgccaccttcgtcaacctgcgcggcatcaccttcaccgcgcggatgaacatcgtgttcctcctggcgcaactggtggtgctggggatcttcctgttctacgcctggaacgccctgcacggtggcgccggtaacggccagctgaccctggcgccgctgtaccacccggagaatttccacttcggcatgctgatgcagggcgtgtcgatcgccgtgctgtcgttcctcggtttcgatgccatttccaccctggccgaagagatcaagagcgagccgggcaagagcgtcggccgcgccgcgctgatcaccctgctggtgatgggcgcgatcttcgtggtgcagacctggatcgccaccgacctggccgccggcatgggcttcaagtcggcggacaccgccttctacgagatcgccgaaatcgccggcggcagctggctggcgaccctgaccgcggtggccaccgcgctggcctggggcgtggcggtggccatcacctcgcaagcggcggtgtcgcgcctgctgttcggcatggcccgcgacggcaagctgccgaagatcctggccaaggtccaccccaggcacaacacgccgcacgtcagcatctacctggtggccgtgctgtcgctgctgatctgctacctgttcatcaactcggtagacaccctcacctccctggtgaacttcggcgccctcagcggtttcatgctgttgcacctgaccgtgatcaatcactactggcgtcgcaaccattcggcccaggtactgcggcatctgatttgcccggtgatcggctttctaattgtctgcgcgatcatgtacaacatgggggtcgatgcgcagaaactcggttgcatctggatcgccatcggcctggtctacctgtttttcctcaacaagctgggcgccgatacggcgctggccgatccactttaatcaatacccccggccgccgcggcaccatgaaggtgctccggcgaatccgagtgggcgccgacaggtgcctgcgtgccaccacccgcccatgcgggcggtggcagtaatgcgtggaaaccgacagtgattgtcaggttcggcgccccgggtttcgcgaccaggcgtcgatcattttgatacaggagtgcatccatgctggtcttacgcccagttgcgccagacgatttgccggagttgcaacggctggcccgtgaaagcctggtgggggtgacgtccctgccggacgatcgacaacaccttttggacaagattctcgactcctgcgcctccttcgccgccaacgtgcaggcgccggggccggagaactatttttttgtcctgcacgacccggccagcggccagttgcgcggctgtgcggaaatcctcgccatggccgggttttccgcgcccttctacagcctgcgcaaccggcccttcgtcagcagctcgcgggagctgaacgtgcagcacggcgtgccgaccctgtcgctgtgccaggacctgagcaaccacagcctgctgcgcggctttcatatcgacccggacctggtcggcacgccaatggcggagttgctctccagggcccgcctgctgttcatcgccgcccatggctcgcgcttcgccgacaccagcatcaccgagatcgtcggctacagcagcgacgacggccattcgccgttctgggatgccctgggcaagcatttcttcgacctgccctatgtcgaggccgaacgcctgtgcggcctgcaaagccgcagcttcctcgctgacctgatgccgcagtacccgatctacatcccgatgctgcccaaggcggcccaggactgtatcggccaggtccacccgcagggccgcgaggcctacgagatcctgctgcgcgaggggttcgaagccaaccactatgtcgacctgttcgacggcggcccgacgctgtacgcccgccacagcggcgttcgctccatccgccagagcctgatcgccaacgcctgcccgggcccgcagagcggcagcggtcgggcctggctggcgagcaacgaacggctggggcaataccgggcggccctggtgcacctggacgaagcgccaggggacctggtcaaccttgacccgcaaaccttccaggccctgcacctgcaaaccggcgacccggtacggctggtcgccctatgaagaaccccggacacgtttgtattcgccgccacaacaggcgcgcagaaggagctgcatcatgatcgttcgcccggtacgcatgactgacttgcccgcgctgatggccctggcccagcgcgcgggcctggggctgaccactctgccggccaaccaggatcgcctgacccatcggattcgctgggcccagcggacctttgccgagcaggtggaacgggccgacgccgactacctgttcgtgctcgaggacgacgaccagcaagtgatcggcatcagcgccctgaccggcgccgtgggcctgcgcgaaccctggtacagctaccgggtcggcatgaccgtcaattcggcgccgcacctgggcatccggcggcagatcccgaccctgttcctgaacaacgagatgaccggccaatcggaactctgctcgctgttcctgcgccccgaccagcgccgtgacagcaacggccgcctgctgtccctggcgcgcctgctgttcgtcgccgagtttccgcacctgttcggcgacaagctgatcgccgagctgcgcggcaagggcgacgagaacggctgctcgccattctggaacagcctgggccggcactttctacagatggatttcgttcaggccgaccacctctccagcctcggccacaaaccctttatcgccgaactgctgccgcgccagccgctgtacacctgcctgctcagcgaaccggcccaggccgcgatcggccaggcccacgaaaacgccgaggcggcgctggccatcctgcgccacgaaggttttgcccatcagggccatatcgacatcttcgatggcgggccggtgatcgaggccgagctgagcaaagtccgcgcggtgcgcgaaagccaggtactgccgctgctgatcggcaccccggacgacgacgcgccgacctggctgatccacaaccgccggctggaaagctgccgcgtcacccgcgcccgcgctcgcctggtgtccggctgcctgctggtggatcgcctcagcgccaagcgcctgcaagtgcagccgggcgatctggtgcgcgccgtgccgctgctggccacccaggccaaggcggctgcggtcgaaagcccaaggacggcgctggctgatgcctgagcggcgccaagggccgcataggactcattcgagcttgaacccgtcatccagcggcacccggtagccgttggccaggcgattggtttcgttggccatgccgaccaccgcctgcaactcaccgaacatcgcctccgtcatccccgccttgcgcgccgcggcggtgtgcgaagcgatgcaatacggacagttgttggtgacgctgaccgcgacgtagatcagctccttggtcagcggatcgagcgcccccggcgccatgatctccttgagactgtcccaggtacgccgcaaggtcggcggatgggccgccaggcatttccagaagttgttcacctgatcgacccggcgggtgcgcatgatgtcgtcgaacaccgcccgcacttccgggctggcgtcggcgtattcggtgaggtggttgctcattgaaggctccgcggtgggggacgaggctttcgagtataggcagagggatcgcaggcgcccgcagccattcccctgtagccgctgccgagcctgcgaggctgcgataggaccgcaggtcctccagcggtctcgagatccttgcgcctgctgcgcagtcgatcgcagcctcgcgggctcggcagcggctacaggtccggccatgcagacaatgcagtgcgtctattcctgcaatcagcgcttggccgacagctccatgatcatccgcgccagcagatagatccgtggcgccacgctctcgacttcggcgtactcctcgggggtgtggatattgccgccgacgatgccgaagccatccagggtcggcgtgccgacgccggccgagaggctggagtccgccgccccaccgctgccctcgatggtcagcttgcgtcccagctcgccgtagatgccctgggccatggccaccagcgcatcggacttctcggtctgcggcatcggcggcaaaccgcgctgcaaggaggtcttgacttcggtgtcggcgatcagcttgttggccgagacccgcgccagatcctgctcgatgcggtcgaactcctccggcaccgccgcccgcacatccgccttggccgtggcctggtcgggaatcacattggtccggtcgccggccttgagcacggtgaagttgatggtggttttcttcgcttcatcccccagcttgcccagttgcaggatctggtgcgccgcctccatcgccgcgttgcgccccagctccggcgcgacgccggcgtgagcggccttgcccttgacctccaccagcgccgtggcgctgcccttgcgccacaccaccaggccatcggccgggcgccccggttccaggttcaaggtcacgtcgtgggccttggcggttttcttgatcagctcggtggcgatctccgaaccggtttcctcgctggcgtcgagcaggaaggtgatctgtgcatagtccttgaacttgaggttatccaggaccttcagcgcatagatcccggcgacgatgccgcccttgtcgtccatcactcccgggccgtaggcgcggccatcctggatgcggaacggccgctcggccgtggtgccttccttgaacaccgtgtccatgtgcgccatcagcaggatcctcgccttgccggtgcccttgagggtggccagcacatggctgccgccggccgtgccgttggggactttttcgatgctggcgccaagcttcttcagctcggcgatggcgatgtcgctcacctggtccagccccgcctcgtagccggagcccgagtcgatgttcaccaggcgctccagcagtttcagggcgtcgccctggtattgctgcgcatcgttctgcacttgtgggtggggggcggcgctggcgtgggtggccagcaggccaagggcgagggtcaggccgatacgggcggccagcaatgagcgaggggaagtctgcgtcatgaatcggtccttgtttcgtgtcggaaggtgcccgcccaccctacctgacaaattcgcccccctccatgctggcgcaatgctctacgagcggcctcacagcgagttcagcaggacctttggcgagcggtcgccgcggccgcagctgaccttgttgcggccggtggtcttcgcctcgtacaaggcctggtcggcatcgttcaaccagtccagggcatcgctatggtccgcggaataggcggccaggccaatgctcagactgacctccagggccggactctgctcatagcccaatccgccgaaacggcaacgcaaggcctccatcagttcggcagcatgctccagcggcacgtccggcaggatcacgcagaactcgtcgccgccataacgcccggccaggtcgctgatccgcaggttctgcttgagcagcttgctcagttggcgcaacacgatgtcgccagcgacatggccgtaggtgtcgttgatggccttgaaatgatcgatgtcgatcagcgcgatggcgccgccctggttcgggttcgtcccctggcgccggcaacgctggaactcgatttccagctggtccttccaggccccgtggttgagcaggcccgacaggctgtcagtgcggctcagggccagcaattcgcgtttgtgccgggacaggacattggcctgctggtagcagataaaacccagggccagcggatacagggtcagcatcggcaggcaggcatagagttgcagcgcactggtctgggccacgaacccgacgccgaacagcagcagcccgacagcgatccccagcgcctgcgccagacaaccggccaggaaaaagggcacgccacccagggcgatattgttcatcgccatcaacgacagggtggtggtggtcggcagcgggttgaagtgcatggccgccacccagaacccgccgaggaaggcatccaccagcaggttgcgatgctcgccgcgaaacggcactggcgagcagcgcgcccactggtacgccaggtgcggccagatgaaagcgttgaacgacatgaacgcccagacccagggcgatgggtgcagcgggtacatgcccgcggacacgcaaaggaaaccgagggccagccccagaattcgcgtcttgtatagcctcctggccagtgaaagtccctttcctccattgtgcggcgtcaaggccaagtcgcctccgttgaacggtacgcaagccatgggatgcggtggtgttcagaagtctatcagcgcaacggcaaatagccatcaccgctcggccgccggaaagcgctgcgggttgcctgagtgaaaaccagcggatgccatcggtccagctgcacgtagccaccctgcccgcctgcattcatttgcagaatgaagtccggaagaaacttcgtttgtcagcacaccccgcgccaaccagaatcaggcccagccaacaccgctaccctctttgtctcactacgccgggaatccttgtttatgagcctgcagagcttcgtcagcccagacctgatccgccaacgtttttcacgggcgatgtcggacatgtaccgcgaggaagtgccgctgtacggtgccctgatggagctggtggcccaggtcaacgccggggtcctggacagcgacgagaggatcgcccggcagctgcgcagcaccggcgaaatccagcgcctggacctggagcgccacggcgccattcgcgtcggcaccgccacggaactggcgaccctcggccggctgttcgcggtcatgggcatgcagccggtgggttattacgacctcaccccggccggggtgccggtgcattccacggcctttcgcgcggtgcatgaaagcgccttgcaggtcagcccgttccgggtcttcacctcgctgttgcgcctggagctgatcgacaacccgcagttgcgtagcttcgccgaatcggtgctggcgcgccggagcattttcaccccgcgcgccctggccctgatcgaacaggccgaaacccagggcggcctcgacgacagcgcggccggagaattcgtcgagcaggccctggaaaccttccgctggcaccacagcgccacggtcacggccgggcagtaccagcaactgagcgcccagcaccggctgatcgccgacgtggtggcgttcaagggaccgcacatcaaccacctgacgccgcgcaccctggacatcgaccaggtgcaagcgctgatgcccgcccacggcatcacgcccaaggcggtgatcgaaggcccgccgcgccgggaatgcccgatcctcttgcgccagaccagcttcaaggcgctggaggaagccgtggccttcaccgaccagcccgacagccgcggcagccacagcgcgcgcttcggcgagatcgaacagcgcggcgccgccctcacccccaagggccgggcgctgtacgaccagctgttgaacgccgcccgcgacgccctgggggactttcccaacgaagccaacgcccagcgctacaacaccctgatggccgaacacttccgcgcctttcccgatgaccacgagaccatgcgcgaacagggcctggcgtacttccgctacttcgtcagcgaacaaggcctggccgcatgccaacaggcggatcgaccgacgaacctgaaggcgctgatccacgccgggcatgtgcgggccgagccgctggtgtacgaggacttcctgccggtcagcgccgccgggatcttccagtccaacctgggcgacgatgcgcaaagccactacgccggccactccaaccggcaggctttcgagcgggccctggggcgcccgaccatcgatgaactgcagctgtacgccgacacccaacagcgctcgctccaggcatgcgccgcggcgctgggcctgcccactctctgattctccgtcccgcagcatcagccagaacggctgatgctggctctttcccgcccccgccgccgggcaatggctacagggtgtttcggcagccctgatcgacaacatgccgatacgaaacagcccgcctcgcccactcccctcctgcttacctttccatgacgccttcaagcacaccgtcagtcgcctgagggtcatcattcctttcaatattgtctctatatggatacagtcactcatggattacgagatcctgcagacgaccgtctttgcccaatggcacaccacgctacgggacctgcgcgccaggatagccatcgctcggcgtatcgagcgggcttcggcgggcaacctgggcgatgtgaaaaacctcggcggcggtctctcggaaatgcgcgtgaatatgggagccggctaccgcatctatttcaccgtgcgcggtaataccctcatcgtcctgctgctgggcggcgacaagtctacccagcctgccgatatctgccaggcccgttccctggccaaggagttctgatatgtccgacaccctgcttcccttcgacatcgccaccctgctcgacagcgaccaggcgatcagcgagtacctgtcccaggtcctggccgatggcgataccgatgaactgatccgcgccctgggccatgtcgccagggcgcggggcatgacgcagattgccaaggccaccggccagggccgggccagcctctacaaggcttttgccccgggagccaagccgcgtttcgataccgtggtcaaggtcatgcgcgcgctgggcctgcagctgtgcaccaccgtgtcccgcggctgaagccgacccaggcggcaggcaatgaaacaacaggctgtgtcggtaaagagtcttgctggagagagccgagcgctcttggcaaccgcgggcaacaggcgtcgaacctgcgcgggtcgcatgaacgcaatgacggaaatcgtggggcgggaaccccgaagagggtgttcgcccagtgctctggcctggcaatccatgcaccggtaaagagcccttgcaccgggcgaacgagaactattttaatcgaacaacaaaagaaagtccgtgcacatattctgaagaattctgaacacaaagctgacggaatttttttatttcgctcaccttcgttcaactccgcgcacggacctccgagatccgacgcgccggccgccacagcgaccagcgcccggtctcattcaaccttcgtgctgggttgtaacttgcaacacgtcggtgtaggtcaccaccacgctctggccgaccttgaggtctttcagccgggcctggacttccggtttttccacgaccaggaccttcttgttacccgccggcccctggaaggtcagctggttgttcttcaggtcgatgtcggtgatcttcagttgcacctgcacctggcgataggcttcaccgcccgggttggggttgtccttggtggcgcgaatcaccccggtgcgctcagcggaatccggcaggcctttttccacattggtgtccagcaccgccaccaccgcgtgagtgacccgcacattgacctggtcgcccaccttcaaatgccccaggtccttggcctgatcgctgagttgcacatgcaccggttggccctgcgcgccttccagcaccacacgatgcttggaggtatccacggagagcactttggtcaccagttcatcggcctccacggtaccggccaacggaatgtcggcggcgtaggcatgcaggctggcagcagacaacagagtggccaaggcaacggctttggccagagagtgaagcggcttcatagaagttcatccctgtaattgaagacaagacccgcgcggttcaggcgcgcggtgccgcttgagcatagacgctgtaaatgcccacgccgccgcgaaccacagattcgttgctgcccgttcaaccaccgagcgcccgcaccagcacagcctggttctgcaattgcgcggtcttgatccgcgacagcgcgttctgcgccgtgagttcgacgcgctgggcctgcagcacatcgagaaacggcgcctcaccggcggcccaggaacgctggatctgctgcgccgccgaactggcctgcgccgcggcactggccagatgctgctggctctcggcattacgccgggccgcggcgagggccgactcgacttccgccaccgcgccgagcacggtacggcgatagccgagcaaggcctggcgcccctcggcatcgcgcagttccaccaccgcgcgccggcgtccgccgtccagcagcggcacgctggcattgataccggccagccagaaggtcgagctggccaggttcgcggcactgacaccatcgaccagcgagcccagggccgccgacaggctcaggcgcggcagcaggtcggccttggccaccccgacccgtgcgtaggcagcgatcagccgggcctcggcggcgcggatgtcgggacgccgacgcagcaggtcggccggggtgccggcatccaccagatccacctcgctcagttgcgccgggctggcggcgaactgttggtacagcgcctcgctcggctgcgccagcaacactgccaggcggtgcaacgagcgctgccactccagttgcagggccggcacctgggccgcggtggactccgactgggaacgcgcccgcagcagatcggcctgcgggctgctgcctgccgcatacagctgctcggtcagttgcagggtgcggctctggctctcggcgttctgccgcacgatgctcaggcgctcttccagcccccgcgcctgggcataggcctgcaccacctcggtgaccagcgccaccttgaccccgcgcgcctcttccgcgctggcctgcaggtcggcatcggcggcccgcacgccttcgcgaatccgcccgaacaggtcgatctcccaggaagcgtcgaggcccaggctcagcggctcggtcatcaagggttcgctgaacccggcctggtccgccgagatccgttgccgggcggcgctggcccccaggttcagctcggggctcgcgccggcggccgcgacgccgcgcaaggcacgactggcatcgatccgcgccagggcaatctgcaggtcgaggttttcctccagtgcccgcgccaccaggcggtcgagcaaggggtcgtggtacagcgtccaccattgctcggcaatgcccgccgccggtatttgcggcgcattgacgaaacgcccggcgggcgcctcgacagccggtggcaaggtcggcgcggcgcaggccgcaagcagcgccgcggtaaaggccagggcgggaaaacgcagcaggttattcatggaccactcccgaagcagagacgctggatggggcctgcaaccgccgctcgcccccggcgagacggcggatcaggacatagaagatcggggtgaacagcaggccgaacagggtcacgccgatcatgccgaagaacaccgccgaaccgaccgcctggcgcatttccgaaccggcgccttcggacagcaccagcggcagcacaccgaggatgaaggccagggaggtcatcaggatcggtcgcaggcgcaggcgacaagcctccaccacggcatcgacgatgccctgcccgtcctgttcctgctgccgcgccacctcgacgatcaggatggcgtttttcgccgccagccccaccagcacgatgaaaccgatctgggtcaggatgttgatgtccaggcccatcaggcgcacgccaccggcggcggccagcagacacatgggcacgatcagcaggatcgccagcggcaggctccaactgccgtactgcgccgccagcaccaggtagacgaagatcacacagagcgggaataccagcaggcccatgttgccggcggtggtctgctggtagctcaggtcggtccactggtaggtgatgcccggtggcagggtctgcccggccaggcgctccatggtttgcagggcgaagtcggagcccagtccgggcaaggtgtcgccgttgatttccgcggtcgggaacaggttgtagcgtgggaaacgctcgacccccagcgactcgtgcaaccgcgtgacgctggcgatcggcaccatgtcgccggcctcgttgcgcaccttgacccgcgccaggtcctctggcgtgacccgatacggcaagtccgcctgggccgtcacccgataggtgcgccccaccaggttgaagtcgttgatataggtcgagccgaaataggtctcgatggcctggttgatctggctgctgggcaccccgagcatctcggcgcgctcacggtccagctcgacgaacacctgcggcgtacgggccgagaacggcgagtagacaccggtcatgccctgggtcgcattggccgcggcgatcagttgctcggtggccttggccagggcctggctgcccaggccggcacggtcctgcaggcgcatggagaagccaccggtgctgcccaggccctggaccggaggcggcgtggcgacaatcaccgacgcgccgctgaccactttcaggcgctcacgcaggtcggcggcgatcttgtccgaggtcaggccgcgcagcttgcgcttggaccagggctcgaacaccggcgccaggccggacgagttggaagaactggtgccggtgaccatggagaacccggagaacgtcggcacccggtcgacacccggcacttgcagggcgatggcttcgatctgccgggaaatctcgttggtgcgctccagcgcagcgccttccggcagttgcacgatcaccaccaggtaaccgcggtcctgggccggaatgaagcccttgggcgtggacaccagcagataggccgtggccgcgatcaataccgcgtagatcgccagcatcaatggagtccgcgccaccagcccccgcacgctaccggcatagcccaccgaaagcttgaggaagccgcggttgaagccctccgctgcgcgcttgagcaggccggccacgccgcgccgtggcgcctgatgcgccttggggtcgtggcgtcgcagaatcatcgccgccagcgctggcgacagggttaccgagttgaacagcgagatcgccgtggccaccgcgatggtgatgccgaactgacggaagaactcaccggagatccccggaatgaacgccgtgggaatgaacaccgcgcagagcaccagggtgatcgccaccagcgcgccgccaatttcctgcatggtgatcagcgtggcctgcaacgggctcttgccttcggccagatgacgctcgacgttttccaccacgacgatggcgttgtcgaccacgatgcccaccgccagcaccaggccgaacagggtcaggttgttgatcgagtaaccgagcatggccatgaccgcgaaggtccccaccagcgacaccggaatcgctaggatcgggatgatcgacggacgccagccttgcaggaataccaggatcaccagcaccaccaggatcaccgcctcgtagatggtcttgcccagctcgccgatgctgtcggcaatgaacgcggtggggttgtagccgatgctgtattcgatgccttcggggaattccttgctcaggtcctgcatggtctgctcgaccaccttcatggtggccagggcattggcgccgggacgttgcagcacctgcaagccgatggccgggtggcgcaggtaataggtgttgttgacgtaggccaggccggcgatttcggtgcgcgccacatctttcaggcgcaccaggcgcccggcgctgccggacttgatgacgatgttgtcgaagtccgccggctctttcaggcggccttcgaaaatcaggttcggctggaaggcctgggacgccactggcggttgcgcgatcaccccgcccgccacctgggtgttctgcgcacgcaccgcggcaatgatgtccgccggtgtcaggttgaaggacgccacgcgctccgggtcgagccagatgcgcatggagtattcacgggcgcccagcggattgatgtcgcccacaccgtcgatgcgcttgagggtatcggcgacggtccggatggcgaagttggaaacgtagagctggtcgtaggtgcccttgggcgaagaaatgaagatggtcgacagctgggtcggcgacgatttgcgcaccgacacgccgctgcgctgtaccggctccggcaggcgcggcgtggccagggccacgcggttctgcaccagcacctgggccttgtcgacatcggtgccgctcttgaacgtcacggtcaggttgaggctgccatcggaggtcgcctggctgtacatgtagagcatgtcctcgacgccgttgacctcctgttcgagggggatcgccagggtctcggccacggtctgcgccgacgcgcccgggtaggtcgcctgcaccaccacggtgggcggcgcgatgtccgggtactcggacgtcggcaggatcaggtaggccaggccgccgacgatcatcagcacgatggacagcacgatcgccagcaccggctgttcgacggagattttccccaggttcatagcggcgctccttcgctggccgaggccttcggcgccagcgccagggcctgctcgctggcggtcgcggtctcgccgacgcgcacccgctggatgccgtcgactattacccggtcctcgggccgcaggccgctggcgacttcacgcaggccgtcatgcagcttgcccaactgcaccggacgcagttccacctggttctgcgcattgagcacatagaccaccttgcgcgtggcatcgacgctgatcgccgtgtccggcagcaacagcgcctgatagctcgggcgcccggagaactgcacacgcccgaactgccccgggctcaggcgcaggtccgggttggccacccgggcgcgctggcgcagggtaccggtggacgggtcgaggcggttgtcgatgaagtccatgcgcccgctcagggtcggttcgctctgccccggcaaggcgatgcgcaccaggttctggcccgcggcgccctgctcctggcggcggtacttgaggtagctctgctcatcgatatcgaagtagatgtcgatggggtccagggacacgatggtggtcagcagggtcgcattgttgttgccgccgttgaccaggttgccttcgctgatcagcttgcggctgatccgcccgctcatgggcgcggtgatgcgcgtgaactccaggtcgagccgggcattgctcaaggcgccttcggcgctcaggacttcggcctgggccgcctgccgcgcctgcaagcgctggtcatacaggctgcgggcaatggtcttcgattcgatcagcaccttggcccgggcatactcctgctcggccagggccagctgcgaacgtacctgggccagcttgccctgggcctggaccaccgcggcctggaaggagcgcgaatcgatgacgaacagcaggtcgcccttcttgacgatggcgccgtcggtgaaggcgaccttttccaggtagccgctgacccgcgaacgcacttccaccgaatcggtagcctcgaaacgtccggtgaaactgtcccaatcgatgatctgccggttcaccggctggctcaccgaaaccgtcggcggcgcgggcggggccagtacctgatccggaccgcagccggacaacgccgacagcagcgccaggccgatggccgacaacgcggcaaacttcaagggtttggatttcatcgcggataatcctggtttcataactttctccggggttggcgaacaactttgcaacccagttttcagccacacaaaagagtcggccgcctactttccagcagcggccacttgaactttaaacttcagttttgtgccgagcccgcgctcaatgcgcggtttctttcgacaaaggcgccggactcctcggcctgcacgccgaccacggaagacaaggccagcaaggcaaggaacagggctgcggattttttcaggctgaacatggcggagaacctcagtgatatttaagttgagcgaattctccgtctttgcgaaaaaagataaatgctgcgccggggaaaagaatattgagtcgaaatcatgaatcgacactttattagttcaacagaaaaccattcacagtctgacgcgagagataaatgaatattgggcaaataactaatgaccggcactcacgaatacctcgctaatagcccgtcatttccagataaccgctgccgacatggctgccgctcaattgcaccgggccttcccaataaggaatgcgcaggttcatccaggccttggggttgagcgcctcggcattgatatccaggccgcggccgggaatgcgcagacgccagcgggtgggcagcgtgcgctccgccaccttggagtcctccagcggggtgagctggatatcgtccttgtgcagggtctgggtgcggccgtcgggctcaatccaggtgccggtgatatagggcggtttgtggttttcccgcacacggaacagcatcagccgttcgccgctgtccaggtgcagggagaaccagtcccacccgctctgcccggccgccaggggctggctgctccattcgcggtcgagccaggccgggccgctgacctgataggtctggccgtcgatctgcaggctgccctcggcctggaaaaacggctggctgtagtaataggacgcctggccctgctcggacttgcggctgtagccgccctcgccctggagcaccaggggccggtcgctgcgcagctgcaagcggtaggcgaaacccgggccgctggcttgcagttgcatatgggccagcgggtcggcgttggcgtcggcggactggctgctgaaactccagtcatcgatccaggccttgaacggctgcaccgtcaccccggcctgccccaccccgccgcgggcgtaacgttcggcggcgtgatgggcagtggccgaagtcgccgcggcgtggcccagccagacattcggcgcctgccagccgggctggtcgggttcggcgcgcaaggcgctgcgaaacagcgtccactgcacgccgaagcgctggccgtcgctggccctgaggtcagcggtgaggtaccaccactcgatgcgaaaaccgtcatgcacgccatggtcggcggggaagctgaacacccgccccggcaccacctgggtgaacgccgcggcgtcctcgcccaggccggcgaaaccttgcgccggctcgtcgcctttatcgcaaccgcacagggccaacaccagcaacaggccaagcagccgttcaatcttcatgggcgaaagtcctgagcaggtccgccggttggctgcgatacaaccgcagcaacggccaggccgacgcgagcaaggtggccagcaccgccagggccagcagctgcaccagttgcagcgggaacacccgcaacggcaggcgccagccgaaggcctggacgttgatcaccgtgtccaggcaccaggccagggcgatgcccaagggcagcgccaggagcaaggtcagcagcgccagcagccaggtctgcccgaggttgagcagcatcagctggcgccggcttacccccagcgcccacagcggcgcgagttggcccaggcggctctggctctgggtcagcaggctgataaacagtgccacgccggccacccccagggtcaggctattgagcgcggcggtggcggcgaaggtgcgttcgaatacctggctcgaccagcccttgagctgcgcctgctcgacgatgcggctgtcgtcaaggccgaagcgctgccgcaaggcactgaccagcggcgccacggcggctggctcgatgcgcagattaaagcggttgggcgtcagctgcggccagtgcgccagcaggtgctcggcattcaccagcagatggcccctggggttgccgtagtcggcatagatcgccaccacttgcggcgcccactgccccgccggcacgggaatctccagccgatcgcccagccgcaccttgagccggcgcgccgtctgctcgctaagcatcaaggtgtcggcgctggccagctgggtccagggttgctcgcccagggcttcgagcaagggccagtgctggcggtagctggcatggtcgaccaccccgtacaagtccgccggccagccttgcagttgcagcgccacctgccagaccggcagcaccgcggccacggcaggttgttcgggcaaccagcgttgcagctcccgcgcctgcgccggggtctgcgggttgatgtacagctcggcgctcaggcgttgctcgagccagtcggcgaaggtctggcgaaaaccggcggtcatgctgccggcgccgatattggcggccagggccagcagcagcgccatcaacgccaggctcagggccggcaactgctgccggcaatcggcgagaaaccactgcccgagcaccgaacggctgcgcccgagcagcgcgctgagcaatgcattgagcagcaccggtaaaccgagggccgcgcccagcagcaggcccgccatcagcacgaaaccgctgcccaggctgtcgccccaggtccaggccgcgcccgccagcgccatcagggccgtcgccacccaggcctgacgccgcagccagcgggcatgtgcctggtgccaggcctggggatcggccagcgccagcaacggcaggcgcgccgcccgcagcagactgttggcccccgccagcaaggcgccgagcaagctcaggccgatcccacccaaccaccacccggggctcaggctcaactgccccgccacctcggcgccatacaggccgcgcaggctggcagcgacatccggtaatagcacgctggccagcaggtagccgctaagcaccccggccagcccaccgagcaaggccaggccaccgagttcgacacacaggcagccaatcagcatccgcgcgctgaccccgcaggcgcgcaaggtccgcagcaggccgcgccgctgctccagggccaggccgatggccgcatggacgataaacaggccgaccaggaacgacaggaaacccagggcatcgaggttcaggtgaaaactctcggtcaggcgcgccagatcgttttcctcactgccgcgcttgagcaccagttggcccttgaacgcatcgggcaaggccgacgcattggcggcgaaatccgccggcaacagcaggcgcgagatctgctgcggcaagcccagcagcggctgggcaaaaccgatatccaccagcagcagccccggcgccatgtccacctggctgtgcagcggcggcagtagctggccgctcgcggtcaccggccgatcgccttcgcgatagccgagggcttccagggtctgtggggcaatccaggtgctgcccggcgggctgacgaattcgaccatgcgcgcggaatccagcacctggccggcgaccgccgcaccggccggcaacgacagcggctcgatcccgagcaattgcaggcgctgctgtgcatggcccttgagcgtcaaccggccttgcaccaccggcgacaccggccagccggcccggcgcaggccgacgaacagctcctgggaaaacgccacgccattggccgtggccaggctggcctggggcgcgccgccaatcaactggctggccttggcgtaactgtcccgcgcctggctgttgagcgcctgcaccccggtcaacaggctggtggccagccacagcccggtcagcacactgaaaaactgcactgggtgccgccgccaatggctgagcagcgcccgcaggctgtgccagaacacccgcacctcagcgctcgcctgcgccggccagacgcccgccatgcagcaatgcgatccgccccaggcgactggccacgcgctggctgtgggtgaccatcaacaggctggtgggggtctcggccagcagctccagcaacagctgcagcacgtcgtcgctggtggcttcgtcgaggctgccggtgggttcgtcggccagcagcagccgtggtttgccggccagggcgcgacccagggccacccgctgttgctggccgccggacagttgctccgggtaacgccgcagcagatcgcccaggcccaaacgctccaccagttgcgcctgccaacgcccatcgaaacgcccggccagccgcgcctggaaccccaggttgtcctccacccgcaggctgccgatcaggttgaactgctggaacaccagcccgacttcggtgcgccgccagttggccaactggtgttcgttcatccgctccagctgctgcccgccgatgcggatgctgccgccatcgaccttgtccaggccggcgatcagatgcagcaaggtgctcttgccactgcccgattcgcccatcaacgccaggctgccgccctgctccaggtgcaggtcgacaccctgcaacactggcaacgggccctggggcgtggcgtagcttttgcggacggcttgaacatcgagcatgggtgggctctggcagcggaaggaaggctcaaggatagcgcttgtcaggccacgaaggttcgcggcgcaccccgcccggcactcagtggtatcgacggactgttcgaaccgcggatgggcagtggctgcccatcctggctaaaggcgcacccatggacatccctggaggtgactgcaacgccgcgccggcagtctgccgggtgaaccctgtccggcgtcgcgtcatccccgcaggccagctccgtgagcgagcccttgtcggtggggtggttacttcggttgctccacgacccgcagatagggcttcaacgtcttgaagccttgcggatatttcttccgggcgtcctcgtcggataccgaggtaggaatgatcacatcctcacccgggcgccagttcaccggggtggcgacggtgtgcttggcattcagttgcagggcatcgagcaggcgcagcacttcatcgaaattgcgcccggcgctcatcgggtacaccagcatcgccttgaccttcttgtccgggccgatgatgaacaccgaacgcacggtggcgttgtccacggcggtgcgcgcgccgccactggcattggggtggatcatgtcgtagagcttggccaccaccaggttttcgtcaccgatcatcgggtagttgaccgcatgcccctgggtctcctggatgtcgccgacccaggctttatggtcgctgaccgggtcgatgctgagcccgacaatcctggtgttgcgtttgtcgaactccggcttgagcctggccatataaccgagctcggtggtgcacaccggggtgaagtccttcgggtgggagaacaggattgcccatttatcgccgatccactcgtggaagtgcagcggaccttcggtcgtgtcggcagtgaaatcgggtgcttcgtcgccaatgcggattgccatgtttggtctccttgcagtgactgggaggggtagttgtcagggagctgacggctgttgcggcggcgttcgggtacggcgtgaacctgtcggcgcgaatcagtataggagacccatcaggcaaggcgagcgcagacaaaaaagcccggcagtgtcgcactgccgggctttggtctcagggtaggccttcaaaaccggtagttggcgctcagttccagggtgcgtggcgcgcccggcgtgatcaggtccaccgagccatgcgccgaggcgtaatagtccttgtcgaagacgttacgcaggcgcagggccatgtcccatttcggcaggttgtacagcaaggccgagccgccggtagcgttcgtcgcagccctgccggctgaaaccctcgaggcccaaaggcagcccataagccagcgccgcccctatcggccaggggcaacgaactattagtattgcggcccttttcttcatcgcaggacgcacagatgaattacacccaggcccaactgaaataccggctggccatcgccgcaggcgcattgctgtttaccggcgccttgatctccaccgtgttttccaccctgaaaatgctccactggcgcctggacagctacactaccgccgcggcgaccatcaaccgcccgatcaagaacttcatgttcaccgtctacgaaaacacccgccccctggactggttctgggacaacagcccaacccccgacttcatccgcctgagcaacccaccccactggaaattcctggtgatctacctgctgatcttcatcggcgcggccctgttcacctggggccggaccctgatgcgcaaagtcgaagcagtcgaacccctgatccaggcccggctcaatgccccagcggaggaaggtgtcgcggtcatgacgttgcagcaactggaggagtcgaccccggtggaagctgtgccttcgttcttttcgcaggttcggctgctttgtgtgctgccggtggggattggggtggtttacgttggggtgctgtggatgttgggcattttgtgagggagatggcggcgggatcaaggcgttcgtcggagactgtcatgctggcccagactgcctcgctttcagcggcgctagaaaccgccgctaaccacgatgaagatcaccgtacagtcgtggttgatctgccaagctgaacgcgttctatgacgtcttcgatgtgctgcatggcatcaacctcaaggtccgccaaggtgaacacttggtcctctgggaccttccggctccagcaaatcgacactgatcgctacatcaagtatctagaaattgctggctgcaccgttccgacaggctgcaatcggccatgggccgctagtcgttagcaaaactgtactgagacgatctggaatcgaagaataacgatagctacccgcagtatagagattgccgagatcgctcgacatctgaggcaatcctatataccgcccgcctcgctgagtctgacccagccccgaaaataggtcgtcgtccagcgtccatagaaagatctgcgcgcgaaaaacacacgaaatgcaggtgcctgtagccataaactgcacatgcggcgagaacaacagtcgatagaattacggatttgagactgctcttacaaggatcagatcaacccgctataacctaggatgcaaaagcagaaaacagcgtaccaatacggagagagttttaaatgacagacgagacgctcgaaactctaacacacgacgaaatagtcgacttttccagattaggggacaaaccgagtgataactacatgcgcgttgtcgacatgctggacaacgttgttcgggagtgtatgtacgtgtcacggagctatagcggaatagcctctccaagtgcaaagcactattatgcatcggtcttgttcactgcacttgtgaccaagggagtgaccctcgctccgatcatgccatttacgccatgggtgaacaaaaggatcgagcactgggactatgcttctgctgctggcatagtgcgaacaatgctagaactgcggatcgcgttctattacttgtgcagcgatcagtgtgacgaaaccgaatgggagtgccgttggaacatattcaatctccacgattgcacttctcgtatccgcatgttcacagcgcttgacaacaatgaagaagtagcgaagctgtcgcaagcagccgatgaaatacgcgatagactcagaggaaatgcgttctttgatatcttgccagataaaaagaagaagactgcgttgcatgggcagtcagcctatctttttccacttgaagatatagctgaagaggctggcgttgagaagaccctgtttagatggttgtacgttcttctctcgtcccacgtccatgcgttgccgatgtctttctttcgcattggcgaggagcgtggcaggggtctaccaacgcctgtagaggaaggctacacgtcaatatgtctgtcacttgcatccacactccttgtgagtacgcgtgacgaggttcattccttgtttcgagatttcaaagcaagggcagatgacataattgagcgcgagaatcgggaagctcaaatggcgctgtctgttttggaagccaagacgaaagcagttgccgctgagggtatgacggttggcgagacgaaggtattgctcttcactgaggtcatgatcattgaagccacgctggtgcaggagaacacagtagaagtgcgctaccgggacaccaagtcgggtgaagttgtgcttcaaagcactgagtcggaaaagggaacatatcttgatctttacgatctgtactactggacgttcatgctgaatggagagcacgtgaccaacaatcaaatgagcttcatggacgcaaataactttgcattcaaggttgacccgtacactagaacgctccatttcaagcacggctgaatatcagctgtcgtcatgcttcgttgcggtagcaggctgagttgctcgaaaccacccccttgggcttcggaatcaccgaaagccagtgcgatggcctctgacgggacttaccgtcctttaggcatcgtgttgcaggcgcgccatgaagatttcgacagatcaccacggtgaagttagccacctggcgcagtatcgaagagcaccagaggctcgggctcgccgcgcttgagcggcgccaggaatgctttgagctggctgataccaccgctaaacagtaccaaccctatcgcgaccggttcttctgacatgtttttctatggcctacccatagcacgccaagacgacattttcccttgatgaggaactagaggagttttcgcattgggacattttctaagtgagtttgaactgacaaagatcagaaccgcactttctgatccgttcaatgacttcccggtggattacgactccatagccaaggaagtaaaagacgtcgatcctgacgtgctgtacgagatcctttattcagaagttgcaccggtgtgtttcaccaatattgcagcagccgtgccctctgtctggacgggttttgatcctgactcactcaacgccatgatcgaagaaaggctggcggcgagggagaataattggttccgcaggcagtttgataaagcgctggttctctggctgaaatacaactacggctatatctggaaggaaatttcttgcaggctttgaggtttggttacgaacgaacattagggtgtcaagtcaatgtaattacgccccaccgccgtcgcctccaacgctccgacacaaccactcaaacatcccctccaatgcacggttgcgccgctcaagcgcggcccctatagttcgccctcgcggcaaaatccgcgaacgaccttggccggtcgaattacaacgacgcatcagcgtccaaacaccattgcagacgctttttttgtgcctgcgattctgtgttatggcggctgtgtgcgggacaccttcgggtgtgccggtgtcgttgtaaaccggtcggccaaccctcacacagctgccaccctcaatttgcttggccgcaaatggtggaagctctacaacgagtaacgaccatggacgatcaatcgatttcccgcttcacccccgtcgacacccacgacgccgacgctcccgttttctacctcgataccgacgcgcccttgagcgatctggcggcttgtgcagcccatcgtttcaccgtggtgcgcgacctgatggacagcctgtccacgcttaacctgaaagatatttccgactgcgatctggcgcgggtgacccgaggggtgcatttgctgacccgggaaggttgtgcggtgttggaggtgattcaatggcgcacggcgcaggaggcctgagcgctattgagcctgggaggctgtttgtagccgctgccgaagaatgaggctgcgatcggctgcgcagcagacgctaattctgcctcccggctttacctgttacaccgcgtcgtcaggtttggcgggcgcttcgtcggaatgccgcccaacccgatcgcagcctcattcttcggcagcggctacagggagcgtcaaccccaagccgccgactcagccttcgcaccttatgaggagatccccgtgcactatcccatctgcatcgagtggggcgacgagcacacggctaccggcatccagattcccgacattcctggcgcggtaaccgccggcgacaccttcgagaccgcgtatagcgccgccatcgaaatcgcccacgtcatgctcgaagaactggcccgtgaggggcaagccatccgcctgccctcgcccaccggcacccaccgcgccaaccccgacttcgaagggatgggctggggcatgctggatatcgatatcacgccttacctgggcaaaaccgagaaggtcaatgtgaccctgccgggttacgtgattcaacgcatcgaccgctttgtgcgcgagcacaacatcaagagccggtcgtctttcctggcggatgcggcgatggaaaagctggggcggtaaagaccgaaaagctctctacacaactccatcaaggccggccggcaggccgccgtcttgctcttgctttggcttttgatctgaacgccccgttaaccacgatggccgaacgcaggcattgagccgtgggtaacccggcagggatgccgggttagccgccccaggccatggatggcctgtggcggcggcccacggatcaatgccttcgttcgggcatgccgagcctaggcgagggaccgagtggtggggcaatgaacgggacaaccacataggtaacagaaaagttcaggcacataggtaacaccaaatcaggcctatgacgccggactgagcctgatgtaaccgtcctgggcatctttcaaatcaaagcgacccaacttgatcgggtccaaatatgacgtcccaaataccctcactgatacgctccagacctaccgtttcgcgcttgagcacattgccgacatagatcctgagccgacctctgttgacgatcccacaagagtcaacgacataggtttctatatggctgggatacctcatcactggtagccgtgccggataagttcgatccgaacagcaataacaggaggccggtgttctctgcccaagcgcctcatgcggtcgttcatgattgtagtgctgctggaacagatcaaagtgcttttgctgagcgccccattcaatttccggaggactgaccagcgtgcttttcagcgtgcggtgcatgcgttcatgacgaccattttgctcgggtcgacccggttggattcgctcgggaatgatgcccagacgtagccaccaaattgacaacagcgacaaccccgcacgccccgcactggcgaaaggaacaccattgtcagtgcgaatgcgttcgggcatcccataggttttgaacaaccgttcgaacgttttttgggcgtctttgaagttggtgctgggcatgctctcgcaggccaacagaaaacggctcgcatggtccatgaccgtcaaggggtaacaccagacgccttctcctgtcaggtattgccctttgtagtcagcgctccatagctgattggggaggtccgctctcttcaacggaattgggtagattgcaacacgctgacgcaggcgtcttggcgttatcaaaccagcccgcttgaggatgttgtagatgctggttttagagggcggctcctgccctggaaaacgctcagccaaagccacctggatcttcttggggcccggtgtcgtaggtcctttggagcgcaactcgatgatcgaggctttgatttcaaagggaatgatatgtgcctgagcatgccgactgcgactgcgctcatccaagccctgcacaccctctgcgttgtaacgggctacccatttgtagcccgtttttcgactgatgctgtgtgccgcacacagttcgcggaagttaaagcgtctcgacagatagtcggcaatgaacatcactttaaggtccatagggttcagctctcgccacggcatggtcagctcctcggaatcgaccctgccagttaaaaactgttacctatgtgcttgaacttttctgttacctatgtgggtgagtcataccgcaaagcgtttttggttcctttttaggcgtttgtaaaaagggactcgccgtaagggcgaaaccgtaagtagccgtgaccgcaggaatggatatgtaccccgtccaacatcaccagcgggaccaccaccgccatcgcgagcaatcgagcgtcgaccggctgctcctacagaaacccagcggccgttaccgcagcaacggatatgcccccaagaagatcgaacccctactgcaccggcaaaaaattcatcagcaacaaactctgcgcataattcaacccaatccgccgataacgctcatccagcatctgcgtcaacaaatccaaccgcgccacaatcttcccaaactccacagcaaaactcagattgctgccctcctccgaaatctcattggaaaacagcaacagctccccattggccccctgccgctggctgagcatccaggtagccttttcaatattgcgcgccgcgttactgacaaactgcgggtcgatagtgtcggtcataaaaaactcggtacgcccgccatgggcagtcaccagcatgctgccgatcgcatagataaaggccccaacccggtcgccacgaaactccgggctcaaggcataactcaacgccgccagatcgcggcggttacccagggccggcaacgccttctgctgctcgatggcctggcggatttcccgctgggcgctggtggcatcggtataaccccactcgcgccactggttggggttgcgcaggtagagcttgttcatcagcaggtaaagactctgcaggttgtcgcgcatgctcagggtggccatgcggtcgacgctggtctggaagaactcctggggtttgccattgctgaactggtggaccatgtcgcgcccctgctgctggctgcagccactggcgcagagcatcaagacagcggccagccacagaggctggcgcggcatacgcaggcaaaacacgcgcaaggaataacgagaaagcggataaaccatcggcaccattctggactctggccgcgcggggagtcggcgcggcctggccctgaatagaaccgcaaaaacgcaaaaagtgcggtggccgggccaaccgtgtatcgccggccagccccgccgaagccctggctggcagcgtgcaggctcgctaaaaaacgccatcaaggcgccaacgccagcccgccaatggccacgcgcccagcccatggcggctcgccgatacggcttcggtggcgggtgcaaaaccagcggcggccttgcatactgcgcgcccgcgcactgcccaaggaagaaacgtgttggcacctgccccctctttgtcgaacctgcttatccgtcgcctgttcaccctgtgctcgtggatcaacgcactcctgagcggcatcgccgtggccgccccgctggcggtgatggtgatcgccgacctgcaattgatcgtcccgcgggacgtcagcggcacgctgttcggcggcgccatgggcttccaactgttcctcggcctgtggctcgtctgcctcctcggcctgaccctggccctgctcacccgcatgcccggcgcccgcctggcctggatcgtcgccgggctggtgccgctgctgctgggcgcctggtggcggatcaattacccggacgatgccgacggcaacctgatcttcagcccgcagtcctgggagctggattacgcgatggcgatcggctgcggcctggtcttcagcgggctgtactggtatcgacacgggcgcctcaagccccggccagccgccaccagcgcggatgtactgttgccccgaatcgtgggcgcgctgatcctggccggtgtgttcatcctcccggcgctgaatttcatcaagcagcccttgcccacctgtgcgttcaacaaggccgggcaacagctgagcgtgtgtttgggggatgacccggatgagcgggtgattgttgattgagggaccgcgctagtcccgccggcaaattgcattgcatcgcctaccgtcgcaggatgtcgccctgacccacaaccgctcaaaaggacgtgccgatgacaattcgtgctgtggttttcgattttggtggcgtgctgttcgactggagcccgcaccacctgtaccgccaactgattcccgacgatgcccgccgccaatggttcctcgagaccatttgcacccaagcctggaatacccagcaggacgccgggagaacgctggccgaagcgacccgcagcctggtggccgaacacccggagcatgcgccgctgatcgaggcctattacgggcgctggccggaaatgctccgcggccagctggacgacggcgtggccttgctggaagaactgcaccaggcgcagatgccgctgttcgggctgaccaattggtcccaggagaccttcccctacgcctgggacaactatccgttcctccagcgttttcgcgacatcgtggtgtccgggcaagagcggcagatcaagcctgacgccgagatctaccacaccaccctgcagcgcattcgcgcgcacctgccggatgtggcgccgcaggagttggtgttcatcgacgaccacgcgccgaatatcgtcgctgccaaggccctgggctggaatgcgattcaccaccagtcggcggctgaaacccgtcgccagttgcaggtcttggggcttttgggcgcgatgtgaaatagctggatgaagccgttgccgcagtgacagcgaggatcaaccgatctgcgataaaaaaggcgatggccgctgccggccatcgccaaatcgccctgctcaggcgccttgcaacgatccgggtgaaacgatgatcttgacgttgtgttccttgttattgaccagctcctcgaagccctggccaacgatctgttccagctggatacgcccggtcaccagcggcgcaatgtccaggcggccgtcggcgataaaggcgatcacgtcggcgaattcaccgttgtaggccagcgcccccagcacctgcttctcggtggccaccagctcgaagaagttgaactcgctgggctcctcgaagatgcccaccagcacgcatttgccagccttgcggatcaggtcgatggccagcttggcggtgtgcttgttgccgatgcattcgaaactgacatccgcccccagcccgccagtcaggcgcttgacctcggccagggcatcgcacgccttgggatcgagcacatggctggcgccgacttccagggccttggccttgcgcgcgccggacatttccagggcgatcacctgggccgcaccggcagccttggcgcacatgatggtgcacaggccgatggtgccggcgccgaccaccaccacgttctggcccagcaggctgccggccttcttcaccgcgtgcatgcccaccgccaacggctcgatcaaggccccggcctcggccggaaaatgggccggcaaggcgtacagcaggttggccggcacattcacccgttcggcgaaggcgccgttgttcatcagcccggtaaaggccaggttctcgcagatgttgtacaggccgtgggtgcagtaataacaggtgccgcaatgctggcaggcgtcggcggccaccgcctggccaacgctgaacccctggaccccggcgccaagggcgacgatctcgccgcagaactcgtggccgaggatgcactggcccttgatcccggtcagcgggtgcggcgcttccaccggaatgaacaccggcccggccacgtattcgtgcaggtcggacccgcagatgccgcaccagtcgacccggatctgcacccagccggcgggcggcgcctcgggcagcggcacgtcttcgacgcggatatcgtgacggccatgccagaccgcggcgcgcatgctggggacggctttgagggaaacactcatcttggcttctccttgtttttgtcgggctgcgacggccccttggccgccgcagaaaacttcagtgctgctggataaagtcgaggatcaggcgattgacctgctccgccgcttccatctgcaccatgtgcccctgccccggcagcacctcgatctgcgccttgagcccggcgctgtggctcaccggaataatccggtcgtcactgccccagatcaccagcaccggctgcccgccgtcctgcaccacggggcgcaggtcggcctgttggcggccttcggcaaacagctggctggccagtagcccgagggccgcgtccaccccttccaggcgcttgaacttgagcatgtcgtcgagcatctgccggtttaccagctcggcgttggagaacagctgcaccagctgcggcttgagggcattgcggttgccggcctcgacaaaaccgcgcaggtaatcgccgttgatttcggcccccagcccggcgctgccgatcaggctcagcgagcgcacccgctgcggcgccaggcgcgcggtgttcaaggccaccgcgccgcccatggaatgccccaccagatgggccacgggaatctccaggtgatcgagcaaggccagcagcacgtcgctcagttcgtccaggtcgccccgttgcagggccttggccgactcgccgtggcccggcaggtcgagggcgacgacccggcgcccggcggccagggcctcgtggttgaacagccagttgttcaggtcaccgccgaaaccgtgcaccagcaccagcggcgtgccgcctgcgccgcgctcgaagtagcggatcagccggccacccagctcgaccttctgcggcgccgggccgctgtcttcgtcggcggtatcgccgggcacgaaagacgcctggaactgctcgatcaccgcgtcgatctcggcgtcgctggcctcgccctcgaccacgatgccgagcaaggcgcccaccgccagggtctcgtcctggcgggcgacctgccggcgcagcaccccggagaacggcgcctcgacgctgctggaaatcttgtcggtttccacgtccagcacttcgtcgcccttgctgatgctctgcccctcttccttgagccaggcatcgacccggccctcggtcatcgacaggccccacttgggcatggtcagggtatggatctggctcatcggcggctccactcgatcaggttcagcacggcctgttcgatcttcgccgcgtcggggatgtacaggtcttccagggcatcggagaacggcaccggggtgtgcggcgcggtgaccatttcaatcggcgccttgagcgcggcgaaggctttttgcgccaccagcgccgagatgtcggtggccatggagcagcgcgggttggcttcgtcgatcaccaccagacgcccggtcttctccacgctttccaggatgctgtcttcgtccagcgggctggtggtgcgcaggtcgatgacctcgcaatcgatgccgcgcccggccaggctgcgcgccgcctccagcgcggtattcaccgtgcgcccgtaggacaccagggtcacgtccttgccatcgcgcaggaagttggcctcgccgaacgggatcgcataggactcctccggcacttcgccctgcaggctgtagagcagcttgtgctcgcagaagatcaccgggtcgttgtcgcggatggcctggatcagcaggcccttggcgtcatagggcgacgacgggcagaccactttcagcccggggatgtgggtccacagcgaggtgagcatctgcgaatgctgggccgcggcgcgcaggccggcgccgaccatggtgcggatcaccagcggggtctgcgccttgccgccgaacatgtaacggaacttggccgcctggttgaggatctggtccaggcagcagccggcgaagtcgacgaacatcagttcgcacaccgggcgcacgccccgggtggccgcgcccacggcggcgccgacataaccgatttccgacagcggggtgtccagcactcgcccggggaattgatggtagaggcccttggtcacgcccagcacgccgccccaggcgtcgttgtcgccgggggcaccggcaccgccggccacgtcttcacccatgatgaacacgctggggtcgcgacgcatttcctgggccagggcttcgttgatggcctgctggtaactgatttttctcgccatgatggtgatctcttcttgttatagaggcattagggataggcgacgtagacgtcgctgagcaggtcggccgggctcggcttggggtcggacttggccttgcgcaccgcgtcctcgatcagcgcgtccacttgctggtcgatctgctccaactggctgacctggaccaggcccgagcgcgtggtgcgctcacgaaactgcatcaggcagtcgttgtgctcgcggtaatgcttgacctcgtcgggcgcgcggtaggtctgtgcgtcgccctcgaagtggccgtagtaacgggtcagcttgacctcgatcagcgaggggccctcgccggcccgagcccgctccacggcggcgccggcggcctcgtgcacagcgaagaaatcgaagccgtccacggtcaccccgggcatgccgaagccggcggcgcggtcggcgatgtggtcgcaggccaccgaccagttggacgccgtggcctcggcgtagccgttgttctcggcgatgaacaggcacggcaggttccacaccgaggccatgttcatggcctcgaacaccgcgccttcgttggagccgccgtcgccgaagaacaccaccgacacgccgtcggtgccctgcagccgcgccgccagggccgcgcccaccaccagtggcgcgccggcaccgacgatgccgttggcgccgagcatgcccttttcgaaatcggcgatgtgcatggagccgcccttgccctggcagaccccggtcttcttgccgtagatctcggccatcatcccgtacacgtccacgcccttggcgatgcaatggccgtggccacggtggttggaggcgatgcagtcatcgtcccgcaggtgggccatgaccccggcggccgaggcctcttcgccggcgtagaggtggacgaaaccggggatctcgccggtggcgaattccacgtgcaggcgttcttcgaatgcgcggatggtgcgcatcacccggtaggcatgcagcaactgctcagtggtcaaaggtgtcgacatttttattctccagggtgtcttcggactgaaagttcacggggtgttgccggtgctggcggtcgatggccagcaggcgctggcgcgccgcatggtccagcaccgcgttgacgtcgatgctcagcgggccgccgccatcgagggtgaccgtgggccggtcgtgggcgttgaattcgatctcgcgctcgccatccagggccagggtgccggcgctcaggcacagcggctggggcacgtcgggcagcaggtagccggcgtcccgcacgccgcagccctgcaacaggcccggggccaggggcaccagcagcgcttcgggggattgagggtcgaggcgcatccaggcgccgtggggctcctggcgggtgaccggcaaccacagcccgcagagcgcggaaatgccgatggactggggctcggcgaaggtcacgaaaacctcggccaggtcgctggcgcggctgatggcgcgggcgccgacaaaggccaggggcgacactgccacgtccaccagggccacttcgcagaggccccgggaaggctcgcgcaccagcaggcgtttgttgcgccgcagggcgattgcgccgggcacccggccgctggcgtagaggccgccggccagcccggcgctggtggcttcgcgcagttccgggaaagcgttgttggtgccggtggacagggtcagcaaggggatatcgccgacctcggcggccaccgccttgtgggtgccgtcgccgccgagcacggcgatcagcgccacctcgcgctcggccatccagcgcgccgcccggcgggtgtcctcgacgctctggcgcagggtcaggtcaaggaattccagggccggccaatggttgtcccgggcctggcggctgcggctgttcttctgcaccgcggcggcgatcccggtcatgtcggtgggcatcaatacctgctcgatgccggtggcgccgaaggccgccagcaggcgctggatcaccgagaccttgtcggtgctggaaaacagcccggcgttggcggtgaggcggcgcacatcgcgccccgaggccgggttggcgatgatgcccacgctcaggggacggcggctcataagcccaccgcgggcggatcacaggcaggacaagacatggggcacctcgttgttattcttcgatgagccagtcggggctggttatccagggatagagcaaggccggtgccaattgccctggaaaacccggacaaggccgatccagagcgcttgccttgaagctggcgaggccttggccagccccaccgatgagacgttgcatgtcaggttgcacggggcttcggcgagaccttgagacgttgcgtctcacgcccgccgccggggcagccggcgcttgtcgaggcgggcggatcggcgcttaattgcgcccacaacgataagaagctgcaaccggaggccttcatgctttccgcacactcaagagcccacgtggactgcgtcagccgggtcctgaaaaacgccgcgcacctgccccaggcgccggtcccgagcctgatcctcgactcctggcgccgctccctggagcagcaccacctggaccccggttcgctacaggggccacgtatcctgtcccaggatgtgctcaaggaatgccgcgagcgctccgagctgttcctgcacattgccagcgaagaagtggcccgcctccatggccgggtgcgcgacgccgactattgcgtgctgctcaccgacgcccagggccggaccatcgactaccgggtggaatcgaccattcgcaacgactgccgcaaggccggcctgtacctgggcacctgctggtcggagggcgaggaaggcacctgcggcgtggcggcggtgctcaccgcccgcgcaccgatcacggtgcacaagcgcgaccactttcgcgcggcctttatcggcctgacctgctccgccgcgccggtgttcgaccctcagggcgagctgctgggggtgctggatgtttcggcggtgcgctccccggacgagcgccgttcccagcacctgatccggcagatggtggtgcagagcgcccgggagatcgaacaggcgttcttcatgagcagcgcccagggttattgggtgctgcgggcccacgccagcccgggttatgtcgacagccagcccgattatctattggcctgggacgacgacggctgcctgcgcgcgctgaacccggcggcgcgcgcctacctgctgcaacgttatggccagctgccccagcacatcgcccaggtgttcgatccgcaattgctgcatcgcgcccgggatgaagcgctgtgcccgctgtccgcggaactgcatggacggctgcgggcgccacgccggcccctgagccgcccgcgcctgagcctggccggcgagccactggacccgcgggtggagcagagcctgcgcctggcggtgcgggtcaaggaccggcatctgccggtgctgatccagggcgagactggttccggcaaggaagtcttcgcccgccagctgcaccaggccagccagcgccgcgagcggccgttcgtggcggtgaactgcgcggcgatcccggaaagcctgatcgagagcgagctgttcggctatgtcgccggagcctttaccggagcctccggcaagggcatgcagggccttctgcaacaggccgatggcggcaccctgtttctcgacgaaatcggcgacatgcccctggccttgcagacccgcttgctgcgggtgttggccgagggcgaagtggcgccgctgggggcgtcgcagcgccggtcggtggatatccaggtgatctgcgccacccaccgcgacctggaaagcctggtggccgaggggcgctttcgcgaggacctgtatttccgcctgggcggcgcgcgctttcagttgccgccgctgcgcgaacgcagcgaccggctggcgctgatcacgcggattgtcgaggaggaatccaagcgctgcggggcgccggtgcaactgggcaacgcggccctggaatgcctgctgggttatcgctggccgggcaatgtgcggcaattgcggcatgtactgcgctatgcctgcgcggtgtgcgaggggccgttgatccagctgcatgacctgccggaacaggtgcgcggggtcgagcccgcgggcgccctgcccgcccaggaaaccggcggcagccccgctggatgccctggtgcgccatcgctggaagccggtggcggccgccagggccctgggtatttcccgcgcgaccctgtaccgccgggtgcagcagcacggcatccagatgcccggacgcagcccggcctgagcggggtcggcgatgcagagtccgtagccactgccgcaggctgcgcaggagacgtaaaacccgcatccatggttgacctgatgcaccgcgctgcctggcttggcgtccgctgcgcggccgtgcgcagcctgcggcagcggctacacagtcgggcgcgcggcagtggctatggggtcgggggttggtagcgcgcgcgatagcgcccggggctttcgccggtccatttcttgaacgcgcggtggaaggcgctgggctcctggaagccggtgcgctcggcgatttcgccgatgctcgcgcggctctggcgcagcagttcaacggccataccgcggcgcacttcgtccttgatctcctggtacgacacaccctcgcgctccaggcgccgacgcagggtgctggggctgacctgcacctcgccggcgaaggcttccagggtcggccactggctgtaatgactgcggcgcaggcgttgatagacctgggtcgccaggccgtgctggttgcgaaaacggatcaccagccactgcggcgcgctgcgcagaaagaccttgagcgaggccaggtcctggaccaccggcaggcgcaggaaacggctggcgaattcaatttcggtgcgctcggcgccgaaggtcaggttcggcccccagagcaaggcatcgtcgctcaaggacaggcgcggataacgaaagtcggcgcggtcgatgggaatgcgccgcccgccgagccagcacagcaggctgatcatcagcaccaggaaggtctcttcgccaaaacgcccggcggcgtcatcgcaaggctggctgtcgaggctcagcaccgcgcgcttgccacgcacgctgaggctgccacggaagtcgcgcaggaacaggccgaaattggccaggcactggcgcagggccttttccagggtcggctcctggatcagcccgcggcagatcagggcgaacgcccccggcggcaggccgtgggaatcgagctggaaaaactcgtcgcccagctcgcggatctggatcagccacagggccgcgaacgcgctgaccggcacccgcgcctcgggctggccgagcaaggccggatcgatgcccgcttcggccagcaccgcggccaggcgctcgggccgctcacgcaaggcgtggaccatgacctgcacgaagtagaccgcgaccgaatccttttcccgcatggaatgactgctctctgtggctgtggacatggcaaaaaacgccagcgcgtttgagcgcttttggcataggccggggtcggcgcgggcactagactcgcgcctcgaaggttgcattgcaagacgcgctcgcgctgcgctgcgacacgtccggacgaagaaagagaagccaagatgaatctgcagaatatcggtgtgatcggcgccggcaccatgggtaacggtatcgctcaggtctgtgcccaggccgggttcgaagtgaccttgctggacatcagcgacagcgccctgcaaaaggccgtggccaccgtggccaagaacctcgaccggctgatcgccaagggcagcctggacgaagcgcagaaacaggcgacgctggggcgcatccgcaccagcaccgactacgccagcctggtcgacgcgcaactggtgatcgaagcggccacggaaaacctcgagctgaaacggcgggtgctgcaacagatcgccgcccaggttgccagcacctgtgtcatcgcctccaacacctcgtcgctgtcgatcacccagctcgccgccagcgtcagcgcgcccgagcgctttatcggcctgcacttcttcaacccggtgccggtgatgggcctgatcgaagtgatccgcggcctgcagaccagcgacgcaacccacaccctggccctggacatggccacccgcctgggcaaggtcgcgatcaccgctggcaaccgcccgggcttcgtggtcaaccggatcctggtgccgatgatcaacgaggcgatcctggtattgcaggaaggcctggccagcgccgaggacatcgacgccggcatgcgcctgggctgcaaccagccgatcggcccgctggccctggccgacctgatcggcctggacaccctgctggcgatccttgaggccctctacgatggcttcaacgacagcaaataccggcccgcgccgctgctcaaggaaatggtcgccgccggttacctggggcgcaagaccgaacgtggcttccaccgctatggctgagcgttgctcgcgttttgccgaaagccgcgacaaggccctggagctgttcgccagcaaggggttcggccaggtcggcatgcgcgagctggcgagccacctggggctgaccccgggctcgctgtatcaccattacccaagcaaacagcacctgctgctggacctgatcgaagagttctacgacgaactgctcggcaccctggggcgcatcgaacggcggcgcaaggcgccggacgatcgcctgcgcaccctgatccgcgcccacctgaaactgcaccgggaactgcctcggcatttccgtctggtggagcgcgacagcggttgcctgaaccaggaccagcagcagcgtgtgcgccaactgcgcgagcaatatgaacgccgcctgctgatgctcctcggcccgctgccacggctcggcgacgcggcgctgctggccaccgggcatgccatcgccagcctgctcaacagcgcgcccggctggctggacgagcagccactgaccgagcacgagcgcgaaaccctgctggaacacctgctcagcggcgccctggaacggctgttgaacagcgcgccgcagagcgccgtggcctgaaccgcggcgcaacaccaatcgccgcccctgcgaccatcgactgccgaccgcactcccacaaacaacaaccgcccctgtagccgctgccgcaggctgcgataaggcccgcaggggcttcgggcgttcttgcgttcgccgcgagcctgcggctcgatcgcagccttcggcagcggctacaagggtgatgcggatgacggggtacaaaaggaaactacggtttctgcgcggctatcgtcgccgcaacgcattacctctggcgaaaaacaacctcctgtagccgctgccgaaggctgcgacaaggcccgcaggggcttcggcgtccgtgcgttcgttgcgagcctgcggctcgatcgcagccttcggcagcggctacagggtgatgcggatggcggggtacaaaaggaaactgcggtttctgcgcggctatcgtcgccgcaacgcattacctctggcgaaaaacaacctcctgtagccgctgccgcaggctgcgataaggcccgcaggggcttcggcgctcttgcgttcgccgcgagcctgcggctcgatcgcagcctgcggcagcggctacaggggaggcggatggcggggcatgtaagtggtggcgccggcttgtattcattccttgtaagcggtgggtcgctgattgccaaacgcgctatagggccgcgtcagttccttgtcctgcctggatatattttttcccgataacggctattcaaagttattcgttcaccctcgcgtttgccccatgcccggcctgcttaactgcaaaagctgccggatagcgcagtctctacaacctcccacggaaggcaacgccatgagttcatcctcgctccaccccatcacgccttatggcgtggcgattcaagaagcaatcgccctcggcaacctgccgcagatgaagtccctgctcaaacaacgcgattcatcccagaaagaatccaaagaactgagcagcgcttacgagcagttggcacaggaagtcgcccgtctggaacggcgctaaggccgttccattttctaatgcactggaggcaatcatgtccggttccacttcgtccaatcttggcttgtttcccctcagctaccggatcggcacttcgatccccggcgcgccgagcctcaccctcgacctgctggtctacacccccgagcagagcgtgcgtggcacctcgctggtgacccaggccgtcaacccacctttggagctgtcgtccgatgtgtgggggcaatacacctacctgaccgtcatgccacccagcaccagcaagatcctggtcaccgcccagggtaatcagggcgggccgggctcgaactcgatcatcaccttcaagattcaactggtggtggatcacgactggaagaacggcatcgccaactaccagtactacaacggccagcgctgggtatcggtggagaacgttcccgcccacctcgtcgagtcggtgccctcctacgccttctcggccttgccgataccgctggagcccggcccggtcctgctgccctatccaccgatcaccccgctgtatgccgcgccgatccatggcgccatcgccagtggcgacctggcccagatgaagagcctggccagcctggcccagcagcaactggagcaattgccccagctgcgcagcgcgctggacgcggccaaggacgagatcggcaggctcgagcggcgctgaccatggcgcgccaacccatccggcttccctgaacaagaacaaggagttgcaccatgcaaactggactgttccatacccgcatccaagccaccacggggctgttgggtgccccggttctgatcctcgacctgttggtcaacaccgtgcagaaaaaagtcagcggcgtggcccgagtgttcaagagcacctacccgccggtgaacttcttcgccgacgtgtggggcgactactcccagttacagctgcacccgtcgaccgaaggccacatcatcctgagcctgaccggcaaccccagcggaccgaccagccagatcgccgcgaccttccagctgcacgggattctcgggctcgactgggccagcggtttcgccagctacaaatactgctaccagggcaactggcaggacgtgcagcacgccacggtcagccaggcgtcgatcccgcaccccgagcctgtgcctcatcaccccgtgccgctgtatgcggtggcggtgcagcaggcgcaaagcagcggtgacctggcgcagctcaaggcggtcgtccgccagggcgagcagcaactggccagcggcgatgcgctgcgcagcgccctgcagcagctgaacgccgagatcgcccgcctcgaagctcgctgaaaggtggcatccgggcctggccttccttcccccagggccaggcccggttctccactggcaaaccctttgtccgcccgggccggcatcgccagggacggcgcggacatccgccaggttcgtgccgcgcgcctgtgtgcgcgcaaaggactgtccatgtcagccaatcgccccgcccgctacctcagcgaaaccgacctcaagcgttacgtaccagtgcatgtggtctgggaaatcaccctcgcctgcgacctcaaatgcctgcattgcggctcgcgcgccggccaccgacgccccaatgaattgaatacccaggaatgcctcgacgtgatcgacgccctcgccgccctcggcacgcgggaagtcaccctgatcggcggcgaagcctatttgcgcaaggactggacccgcctgatccaggccatccacgaccacggcatctactgcgcgatccagaccggcgggcgcaacctgaccccggcgaaaatgcaggccgcggtggaggccgggctcaacggcgtgggggtttcgctggacggcctggcgcccctgcatgacgccgtgcgcaatgtcccgggctccttcgacaaggccgtggacaccctgcgccgggccaagcaggccgggctcgcggtcagcgtcaacacgcagatcggcgcggccaccctgcccgacttgccggagctgatgaaccagatcatcgaactgggcgccacccattggcagatccagctgacggtggccatgggcaatgcagtggaccacccggaactgctgctgcaaccctatcaactgctggaagtgatgccgctgctcgcgcgtctctaccgcgaaggccaggaacgcggcctgctgatgaacgtaggcaacaacatcggttactacggcccttatgagcatatgtggcgcggcttcggcgacgaacgcgtgcactggagcggctgcgccgccgggcaaacggtactggccctggaagccgacggcacggtcaagggctgcccttcgctggcgacggtggggttttccggcggcaatgtgcgcgacatgaacctgcacgacatctggcactacagcgagggcatgcattttggccgcctgcgttcggtcgacgacctctggggttattgccgcacctgctactacaacgacgtgtgccgcggcggctgcacctggacctcgcactcgctgctgggcaagcccggcaacaatccgtactgccactaccgcgccctggacctgcagaaaaagggcctgcgcgaacgcatcgtcaaactcgaggacgctgcccaggcgtcgttcgcggtcggtcgcttcgacctgatcaccgaacgcatcgacaccggcgagacggtcagcagcgtcagcgacagcggccaggtgatcaagctggcgtggatcaaccaggggcagaaatcccccgaggaaggacgcctgcccacccagctggcgctgtgccgcggctgctggcagtacatccatgcccacgaaaccacctgcccgcactgctcggccgatgtggccagcgccgaggccgactacctggccgaccgcgcccggcaacaggcgatcatggatcgcctgaccggcctgctgggcatgccccagacccggctggtgtagccgcctaggcccgccgccaaccgggcggcgggcctggcagggggttgcaccaagggtgataacccgctacgggcccatgagaaaaccgtctaaaaacaagcccactgccacacaggtttaggctttgctagggaaggcctcaacccatcagcttctgccagcgggccggctcacccggcgcgcccgcggcccctgccatccgggagtcccagcatgaaaatcaatccctacctgatcttcaacggcgattgcgccgccgccttcaagttctacgcccagtgcctgcaaggcaccctcgaagtgatgatgaccttcggcgaaagccccgcccgcgaccatgttcccgccgagtgtcacaacctagtcatccacacccgcctgctggtgggcgaccaggccatcatgggctcggacagcacgcccgaccggccttattcgggcatccacggctgctcgatatcgctgaatgtcgacagcatcgccgaggccgagcgggtgttcgccgcgctggcagaccagggcactgtgcagatgccgctggaggccaccttctgggcggcgcgcttcggcatgctggtcgaccgcttcggcgcctcgtggatggtcaactgcgaaaaggaccagtgacaggcgcctgtcgttaagccaaggtgccgcggcgatccgcggcccctcaggcctcgccctcggcctccatcgcccgcagcccctccagccgctgacgtatgccttcactggccaccggcccggcctggaccgtgcacgcctccagcggcaccgggcgaccatcggccaggtcggccatcatcggccgcaccggccggccggtggcgcgctcgacgatctgcacgctttccccttccggcgcgtaatgacgattgccccaggcgacgaacgccatcagcaccacacgaaaatcctcgccccgggccgtcggtacatattggtagcgcagcggccgctgactgtaggcctggcgctccagcaagccgtcctcgaccagcgaattcaaacgccgggtgagcatgttgggggcgatctgcaggctgcgggaaaactcctcgaaacgccgcaggccatgcagggcgtcgcgcatgatcaggatgctccaccactcgcccacccgctccagactgcgggcaatcgggcattcgtcgtgaaggagggtcttgcgttgcatggcggttcctcggatttcgcagttgcgtatttgtggttcgggcatgttactttcatgatgatagtgacgtccatagagcgacacaccccacacgagatgaaggagctgaaggtcatgaacaaacgcattgtcgtcaccggcatgggcgcattgaccccgctgggctgcggcgtcgaacagatctggcaacgcctgctggccgggcaatcgggtatccgccggctaccggaagaactgattggcgacctgccgatcagcatcggcgggcaggttcccgaccgcaccgaggacccacaggccggcttcgatccggacgcgctgctggcgcccaaggaacagcgcaagatggaccgctttatcctgttcgccctcgcagccgcccaggaggcgctggcccaggccggctgggcgccgcagacggcagaggcgcaggaacgtaccgccaccatcatcgcgtcgggcgtgggcggtttcccggccatcgccgacgccgtgcgcaccaccgacagcaaagggccgcgccgtctttcgccgttcaccattccgtccttcctcagcaatatggccgccggtcatgtgtcgatccagtatggcctgaaggggccgctgggcacgccggtgacggcctgcgccgcgggcgtccaggccatcggtgacgccgcgcggatgattcgcgccggggagatcgacgtcgcggtctgcggtggcacggaagccacgattcaccgggtcagcctggccggtttcgcggccgcgcgcgccctgtcgagcgatttcaacgacacgccggaacgcgcatcgcggcccttcgaccaggcgcgcgacggcttcgtgatgggcgaaggcgccgggctgctggtgatcgaggagctggaacacgccctggcccggggcgccacgccaatcgccgaactggtgggctacggcaccagcgccgacgcctatcacatgaccgccgggccggaggacggcgacggcgcccgccgcgccatgcaacaggcgttgcgtcaggctggcgtcaagccgtcccaggtccagcacctgaacgcccacgcgacctcgaccccggtgggcgacaaaggcgagctggcggcgatcaagagcgtgtttggcaaccacagcgacctggccatcgcctcgaccaagtcggccaccggccacctgttgggcgccgccggcgggatcgaagcgatcttcaccatcctggcgctgcgcgaccagatcgcccccgccaccctcaacctggaaaacccggatgccggcgccgaaggcctcaacctgattcgtggccaggcgcagccgctggcgatggaatatgccttgtccaacggcttcggctttggcggggtgaatgccagcgtgctgttccggcgctgggcgtaaggccgggattgttcgccgggcatggggaggtttcagtgcgggttagctggaacctcaatgtgcccagtcagtcccgtgcaactgagtattttcagccggatgtcaaaccatccggcaccttcgccaggttgtcgtgtgtgccatccgggctcaaaggttgggaggatgagcaactgcgggtcatcctcgagctaaccaaactgtaatgacgccggatttatagcggctggatcgggctttcactaggacgatcgtgccaacacccccttaccttacccacaccctccaaatgaatgagtagcttgggcgcagattccggagcgtgcagtcaccaggctccgaaatccgagcgaagaagaacaagaagacttcagctcttgttttttttcatgactttttagtttgtgagggaaaacgaaccatggcgatattcgactacaagggccaagacggccgcgtgctgatttcagatgcctggaacctggccacctacaccagcggcgtagcgacggtaggcgcgctctaccacttgcccggggcggtcctgggcgaaggcaacacctttgtcctgcccaagggctggcgcgagatcagcgccagcgacctgggcatcgacggcagccacctcgacctgacaggcagcttcaagggcgaaaacgtatccggctcccaggccaaggtattcggccaatacgatgagagcggcaagctggtcaaaatgggcttttcgattgccggcaccaactcgccgatggacttgctgggatacccggcaatgatcgacaactcctacatccacggctacgactacctgctcgactcgatcaagaactacgccagcagccataacctgacgggcaaggatgtgctggtcaccggctacagccagggcggctccgtgaccaacagcatgtaccagggcagggaaaccctgtccgacggctttttcaaggattcggactacttcggcatggcgtcgccaaaggccagcaacagcgacggtatcttcaacttcggcttcgaaaacgacatcgtgcaccggctgatcggcgaacagaccgacctgagcggcgccattctcgcggccctcaaaggcagtgacgccagctacacctcgaccaccgacaacatcgtgctgttcgacacggtctacgctttgcccacctggcccaacggccccttctccgtgatcaatcccaacggctgggtggcgcacctggaaggcgttttcatcaaccctatccagcgcatcggccagtcgacgttctacgactacatcgagcgtgacagcaccatcatcatcagcaacctcgacccggtcagccgcagctttacctgggtcagcgacaaatactccgccacctccaaccacttcggcacgccggcctttctcctcggcacggacagcgcagacaagctgcaggacggcaggaacgacgacttcctcgacggtttcgccggcaacgacagcttcagggtcagcaccggcaccgacatcgtcgccggtggcgtgggcgacgacaaagtcttcctgcagggtacggtcaccagttacgaagccgtgcgcctgagcgatggcagcttgtttctcaacgacaccaacgggcgttacggcctcaaggagctgcacgacgtcgagcatgtcgagttcgaaggcctcctgggccaggccttgaccccggcctttaccgtgaccggcagcaagctcgacttcgaaggcctgttcgggtcggacaagagctacgccaaggccaccgaaggcacgcagttggcagacctgctgaagggtaccgcctcccgcgacctgatcttcggccagggcggcgacgatcttatcgaaggcggcgcgggccatgatctgctgcacggtggaagcggcaacgacaccctgctcggtggcaatggcaatgacgcactctacggcggcgcgcacaacgacatcctggtgggtggcctgggcaacgacaccctcagcggcggtgtgggcagcgatctgtttgtcttcgacgtgggcggcttcggccatgacgtgatcagcgatttcaacgttcaccagaacggcttcgatcagttggtgttttccaagtcgctgttcgcctccacagccgccgtcctcagcgccaccagccagcaaggcagcgacagcctgatcgtggcgggagacagcagcattaccctggtcggcctcaaccccgcgcaactgagcgcggacatgatcagcctggtctgacgttcgatgggcacaccctccgttcctgtgagggtgttgctccagccggctttggccatttcagaaacacaaagggtccaccttggggtgggccctttttttgatcgtccgttctttatttaggccacttgagccatcggcaagcggcatcgccacgcgagaaagtcccaccggctgcgccgtggcgcatcacccgccggggccgattaccaggtttgatgagttatcactcaagtttggtaaagacgcccggctgtgcgaaatctacacagcggtcgagatgccggaggatgcgcaggacttagctattcgcgcccgcttcgaagaactgactcgcctactcccccagcgctatggcgtgccctcggcagccatcgaccaagcggcggatgaacaagcgagagcaggtcctgatatcccactggctggcctcccaaggggcgagtctgaaaggtgcgcgggaagccgtgctgaccctcggcagacgctatgtcgaccccatcagtgtcagcctgtccatttccggtcccgggtccgaacagtgccagcaggagcaacgtcagggatcgaccgacgcttcttgaatggcgcaggtctgggccaaggatcaatgacaaaggttgaagagcggtatttgatgaggggcgcggcatgcgatatcggaagctttaaaccagacatgctcgataggcgtttttttgcaggaaatacctaagcaacttgtctcaagaataggtgcgcgggataccgatcctgtttccatgcattgcactagccggccgtcgatgtcctggtcttcccaggagctgccttggctacaggtgagtttgaggcataaaaaaggttcttcacggaatcccgggaaacacagaaacaagaacgccgatttgattgatgatgttcgtgcgagcaaacacatctaacaaaccggcgttcttatgcgtgatattaatactttccttcccttttgggagggcttttctgtcgtcacgatcaagcctgatggtgacgcgctccagatcgatctgattccccacgccacccgattcccttcctgtggcggctgccaaaaactctgttcaaccacgcatgagtactgccagcgagtcatccgcgatctgcccattcttggccgagcagtgcgcctcagcgttttgcttcggcgtgtcggctgtcgggactgtggcaaacgcatggaggccgtcagttggctggatcgctatgcccgcatgacgcgccgcctggccgatgcggtcattcaggcctgcgagcgccttcccacgctacacgtggcccaactgttcgggttgcattgggacagcgttcgcttgctggaacgtcgcgccttgcaagcggcattgagtgttttgccaaaggcgcagccacagcgcttggtcatggacgaatttgccctgttcaaaggtcatcgttacgccagcgtagtgctggacgccgatacccggcgagtgctgtggattggcgaaggccgcagccgggcggcagtcagaccctttttcgaagagctggggtcagagggttgcgctcgcatcgaagcggtggcgatggacatgaacactgcctttgacctggaggttcgtcagcactgcccaaaagcgcgcgtggtctacgacctcttccatgtggtggccaagtatggtcgagaggtgattgatcgagtccgcgtcgatgaagcgaatcggctacgtcacgacaagcctgcccgcacggtcatcaagcaggcgcgatggctgttgctgcgcaatcggcagaacctgaaaacgccggaacaacaagtccgcctggaggatctgctggcggccaaccaagcgttgatgacggtctatttgatgaaggctgaactcaaaacgctttggacaccgagcaccgcctggggctggcgatcagcctggcgacaatggctgcgccatgcgcatgaaagcgacataccgcctctgatccagtttgccaaacgactgaagggttactggcggggcatcgtcagccgggtgcgctggccaatgcatacgggccagttggaaggcatcaacaatcgaatcaaggtcatcaagcggatggcgtacggttaccgggacagcgaattctttttcatgaagatcaagagcgtctttcccggtaatccgtgaagaaccataaaaaagcctgtactgagtgggcaaaggactgatccggatttcaggcacctgactcagggtcgctcgcgggcatgccacgagactccttgtccttttcgtcctgtgtatctgcgccaggatcatcgacgcgaccacttttccctgcttctggatgctcactcgacaccgagttgtttacatctacgtcgatcatctcttcatcgaccggcgcttcatcgttcgcaggcaatggaacctcaggctccttacgccttgggtcatggcctgctccgctgtccgaggttcgctctacgccctgctgcgaccagctaccaggtgcattttcgtcattgttcatgttggctctccgttctaatgctcaggaaatccgtacttaaacatgagaaacggcagagccttgcaagtgccgagaaatggataaacggtggtcaataaaaaaccggctcgatggccggttattgcggcgagcccactattccgacggcggaattggatcagctcattgtggcggcaaataaggtatccgcacccgactcgcgcgcaccaacgctgacgattctgaaaaggaagaaggcatgaagaaaagggccaaggtcactcgaaaagtcactacggcagaaacaacaaagccgctcgaaagctgctaagtcattgaattatatggtcgggacggagtgattcgaacactcgacccctagcatcccattcagttaagcattagacatccttggctctcgccactcccctgtagagtcctaaggcccattaaaataaggcactttcagtgcttaacccttccaatgacctctatcccgatctacccttagctgacgaatcagtgggagtaaatgtgggagtaaacttatcaagaggtagattatggctaagctcactgccaaggaattggaagcactgaccgaacaggatgtcggcatcatcatacgcgacgaaggtagcctcgcgggcagagtctcactgcgcaaaaaaggtgtcgccatccccttttacttccagtttcgctgggaagggatttacacccgtttctcgtgcggaacctggccaaataaatcgttgaccaaaatccgcaagtgaatcgccccggcttttgtggaggccgtttcgtttaagtcaggccgccatggcctgacctgcttgttgctggtggaagtttgcctcagcctccgcgggcgggatatatccgattgagctcagcaggcgttggtggttgtaccagtgcacccatttcaaagtcgccatctcaacagcttcgcggctcttccatgattgacggtaaatcagctcggccttgtacagcccgttgatggtttcggccaaggcattgtcgtagctgtcacccttgctgccaaccgagggctcaatgccggcctctgccagccgctcggtgtagcgaatagagacgtactggctgccacggtcgctgtgatgaatcagtccatcggcacggtgtggctggcgggcatacagggcttgctccagggcatccagtacgaagtcggtcttcatgctggtactgactcgccagccgacgatgcgccgcgcaaagacgtcaatcacgaacgccacgtacagccacccttgccaggtcgagacataggtaaagtccgagacccagagctggttcggacggtcggcatggaactggcgttgaacacgatccagtggacacagcgatttgtcgctggccaccgtcgtccgcacaacctgtccgcgccttataccctgcaatcctgcctgccgcattagccgctccaccgtgcatctggcgatcccaatgccctctcgctgtagctgcttccagaccttcaccgcgccatagcactgcatgttggtatcccatacacgctggtgatctccagactcaacacctcatcgcgttgagcacggcaacaacgcaagtcagggttacgtagttgggccgcatgcctgcggtaaccggacggggcgatctgcaaaacacggcagatcgactcgaccccgagacggtcacggtactggtcgacaaaggccctcaggacttggtacggcggtcgagttccgcctgggcaaaatacgcactggccagacgcaggatctcgttggctttgcgcagttcgcggttctcacgctccagagccttgatgcgctcgcgctcttcggtggtcggccccggacgctgaccggcatcggttggatgacggcgaatccagccatgcaacgtttgcgctgcacagccgatcttcggggcaatggcctcaatggccgcccactcggacgggtagtcgttcaggtgctccagaaccatgcgcacggcacgttcacggacttcaggggaataggtcgtagtctttctcatggcctcatcttctcaagagttgaggcctccacgaaacccggggcgattcacaaggagcgcaacgaagcgcgtgagcttgtagccaaagggatcaatccgaatgaaaacaaacgagcaaggaaggtcagactaaaaacggagctggctgcacaacgtgcagaagccgaccagcgaaaatctaagaatctaacactgctagacctcgcaggagaatggcttctcgatggcgtggcgcgcaaggatggtaatgccgagttacggagaaaattcgcgaaagatctttaccccgcccttggctcaaaagtcatcagctcaattagtgagcatgacctgcggattctggtgcgatccgtaatggctcgcggtgctactcgtcaggccatcagtcttttttcggatatcgttcagatgtttggatgggcgcagaaacgccagccatggcgaacactgctggtcgacggaaatccagcagacttggtcgaaatcgataagcttatacccagtgactatcaggaggagagaactcggctcctctcatcaaccgaacttcaagaattacaccaacgctttcagaaaatgactgccgactatgcagcactacctgccggcgaaaagtacgatggaattcgcccactgaaatcagaatcccaacttgcgttttggatctgtttgggaacgttatgccggatcggtgaactgcttcaggccgaatggaaaaacgttgatctagaaaatggcgtctggtttattccggttgcaaacgtcaaaggcagccggagaagaagcaggaccaccacgtgttcctatctgcatttacaacccactatttcaacaagcttcggcagctcacaggagactctcaatggtgcttccccgcaaagcatcatgatgggcatgtcgatctcaaggtcgtcagcaaacaggtgggagaccgccaatcacgtttcaaaagtcgcaagccgttagcacgtcgccgacatgatgacaccctggtgctgtccggtggtttgaatggggaatggacacctcatgacttgagacgaacgggtgcaaccatgatgcaagcctcaggagtaagccttgatgtgatagatcggtgccagaaccacgtgctggcaggttctcgggtccgtcggcactacttacaccatgattatgccgcagagaaaaaagaagcttggaacctgctgggcgaaaagctcaccgacatcttgagcggcaaggatgacaagggtggaaagtttcatagagtcaatttcctgaggtaataaaggggagtgccgcttgggccatatgaaagttatggatggcactttataaagtgttgttattaactggccattaagtatttataaagaaaacacccatcaattttcgttcgtgcaatttctttgaacctgatagtccaaaacatgctcgcgcccctgatggtccaaataatcgagacgtgcgggaaccacaccgcactggtccgggatatcagtcatggatatgacttttgcaacgtccatatgaacgtagaagccggtcttgtcgtgaatcaccggtgaggtctctgtgtcggcaaaagctgaaccggcggtgagcaatgcagcaaatccaagcataagcaatttcacgaaggtatctctctagtgggaggttgcttgttaactggtaatgagcccacagcaactagcaagtaatgcggtattggtcggtgaatgactcgagttcatcctcccactctcccccagctatgcacgaggacatttttgcatgcgctccatgcctcagcggcatgggttacatcccacagcaccaacgagaacgccaaagccacctgcacgcctgcatcgcaccaatgcatatcaaaaaggcatatgacgtatcgaaaacaagcaatggtgcatatgccagcagcaggtaacgatgtgtcgcacctcattggtgctgcctggcaccactcggtgacccgcacattccccttcagctcgcttggagcctcactgtgaaaaaaatcctgcgaatcgccaccgctctcggcttggcggcattcaccaccggcgcattcgccgctacgatccattgcgacacctcgcattccatgggcatccaactgctcggttctggtggccccatctctgacgacgcccgtgcttcgtcgggcgagattgtctggatggatggcaagtcgcggctgctcatcgacgccggcggcggtacgcacctgcgctttggtcaagcacatgcccggttggaagacctacacttcatcggcatttcgcactttcacacggaccatagcgccgacttacccgccattttgaagggcgcgtactttatggcctcgagcaacacgattgccctggtcggtccggacgggtctgactcgttcccgagcatgacggaattcttccacgacatgttcggcgccaagactggctcgtttgcctacctcgagggcctgcatgatggaagcgatgggttgaacctgaaggtcagcccgatcatcaatgcggatcgccacgcagagaaggcgtccctcgtttatcaagacgccgaagtcaaggtatatgcctacggcattccgcacggcgatgtgccgacccttgcattccgcatcgaaagcaagtacggcacgatcgtgatctccgcggatcagaacggcagccgcgccggattcgtcgactttgccaaaggcgccgacatcttggtcatgccggccgccatcgacgacgatgccgacgccacctctaagttcctccatgcaacgccgacggtcgtcggcaagatcgccgcagccatcaaccccaaaatgctcgtcctcaaccacttcatgggtaagtccctgaggaacaaggacagcaacgttgcaaccatcaagcgctactaccacggcccggtctacgcaggacgtgatctgtcgcgcttcgaaattccatgacccaggagcactccatgaagcacacactcgcgctatccatcgccgttgcctcgctcgcctcgttcgccgtcatcagccagccggcgcatgccagtgaacccccgccaccggccatcgccaagaccaccaagggtggcggcaaatgcgccagcggcaaatgcggcaccgagaagatctacagcaaggccaagatcagtcaggacccacaggaccgcctggtccgtactcgtgacggtaaatgtggcctgaccgctcaaggatacgacgtcgccgaaacgacccagaagaagctcgccgaaggggtctgtggccaatgatcatccaaggacgagggcttgggctgcggcgtgagtttgccttgcctctcgccaacggtcccgctcggactgacttcgactttctagaagtcgtaccggacaactggatgcagttgggcggagagagcatggaacacttcgacgccatcgcggccaagtatccgatggtggcacacagcttgagcctgtccatcggcgacgcgcaaccgctggatatggactacctgaacgcagtgaagaccttcttggacaactacgacattgcgatttatagcgatcacgtgagcatgtcgcgcgacagccgcggctacctgtacgaactgatccctgtgcaccgcacgcaggcgagcctgcagctgatggtcgacaagatcaaggcagtacaggactacctgtcgcggcgtctctcgttggagaacatctcctactactacgacgaggacgggcagatggccgaaaccgagttcatcgcccgcctggtctacgcctcgggctgcgggctgcttttggatgtcaacaatgcgtatgtcaacgcacgcaatcacggatctgacccgcgcgcgtacatcgatgcattgccgacagacgcggtgacctactttcatgtggccggtcatctcgacaacggtcctcaagagcaggtgctggacacccacggcaccgatgtgtcggccgccgtactgggccttggtgcctatgcggttcagcggttcggcgaacggcccattgtgctggagcgcgacaacaacatacccggcctcgacgagctatgtgcggaactgcacggcatccaccaggccatgaccggctcgacggggagtctgcaatgaacttgcacatcgccccggatgtcgccgacgaagctgagcgccggtgccaggctgtgcgccgtggtgatctcggcccctatggtgagttggtccgtgcgaacgctcaagagctagtcgccacgatgttcccgcggtttacccaacatcgcggtgccgagcgcctgtaccaggacatcgacgcattctacaaatgctttggtgcggcgcgggccgaattcgttcacctcgcgaccgagtttgtccgcttcatgcagccgcgcctgcctccgggtatcgggcgccccctcatcgagtacgagtggatgttgtttgacgtggaggtcgataaggccacagttccccgcccccatggcggggacgcgccccgcccgacccgccttcgcctcaaccccaccgtgcgatggctggccactccgtttgacctgcatgcggacgaccgacttgcggagcaagcgctgctacgccacgacgcgccttgtgcctatgccgtctttcgcacattcgaccatagggtcgtgacgcaacgactttcaaaccacgacatcgcagaactgtccaccttcgcgggcggtgagcgagtcgtatccccgatggaatcagcccactggttcacccacgcgcttaagcgcgaactcatcacctcacaccacgaatagtagggcatcgccatggctaaactgatcgcactcctcaaccgcgccctcgaaaagtccaaaaagctggatttcgtagcgctgctttccatccgcctgtacctgctgcccaccctctatgagggcacccacgccaaagtcaccggtttcagtggcctggtcgaatggttctccaccccggtggcccaaggcggcctcggcatgcccttgcccactctgatggccaccctggctacgggtactgaagtagcggggctcatctgcatcgccctgggtctgttcacccgcatcgtcaccattccgttggcgatcttgatgaccgtcgccggcttgtccgtgcactggacgcacggttgggccgcgattgccgacaaaaccacggaagccagcatgcgcctcagtggcctaatgacctggctgcagcattccttcccaggccgcttcaactatgtcacggaactgggcgatccaatcatcctcaacaacggcatcgaattcacggtgacctatgccgtcatgatcatggtgctgttcttctatggcgcaggtcgctatgtcagcgccgaccattggctggccaaggtcttcccgcgctggccgaagtgaccatacggccagcgcagcggctcgatcttggggctcgttgcgctagccatggtcaatgtcgccgggcatgtcgatcaatgaccggcgcgtctacgggtaacggctcaatccgcgttctgaaggttacgtttgagtactttgggcagagctcaccgctcggcccatttttttgcccgtcgtttgcggttactgctcgagcaaggcaagcaaggcgcgctcggccggcccatcggctacggccgcgcgacgcacaatggtcaacgttcggcgaagcgtgatctgcgcgcagggtaatgggatgagcacgtcgttggccaattcatccgtgatgctgatggcgggcaaccaagcgatgccgccgccatggatggcagcctgcttgatggcctcggtgttgccgaactccatgaccggtccttgtcgcacgtccagatcgtcgagcactgccgcgatcaattcgcgcgtgcccgatcccacctcacgcatcagcaatgactcgtcattgaggtcctggggtttgatggcggtagcatcagcgaaccggtgccaggcggccactaccggcaacaaatcgtcctcgcgaaattgggtcgcggtcaaaccgtctacacgcaaagggccctcgataaagcccaacgaatagcgcatgtctgcaacggcctgggagacctgtgccgtattgcctacgaaaaggcataccttcacacctggattgttactgcgaaaacgtgcgagcacgcgcggcaacacataggtgccgatggtgttactcgccgctatggataaatggccgatcctggcgctggcaagttccttcatagccagatcagccgttcgggcaatgtcaaagaggcgatcggcatattcggcaagcacttcgccggcgtgcgtcaaacgcatgccacgcggttggcgttcgaagagtgtcagaccgaagcgctcctccagtttgcgcagttcgcgagacaaggccggttgcgagatgttcaacgcctttgcgcaggcagtgatgctgccggttttggcaatcgtgtgaaagactaagaggtgatgaaggttcatgtatgtctagaaagaaaggctatggccaaatattatcggacacccggcccatccacgatctggacgatgcagcccgtgcaagccgtaaagtcgaagtggcgcgacagcgccgagctgacaccgtggcctggcggatcaactaattgcacgatattagcctgtccgccctcccctgcacatcgctctgcccatgagataattgacaatagaaagcaatggccagtgacacactaacacctaagaaaccaaggatattcagtgtatcgccaatattgaactgggaagactgagggacgttgcccccattcgatggccgcgagctgtagttacttctcctggcaatgccttttaaaggataaggcaagaggatcagttgtgtggtaattgaaccacaccagactaacaatcaataaaaagccccacaggcagaatcctgttcgtcttttcccaaagaaaatggcagtcgcgctcaacagagcaatcaagaacggtaaaaacatatacattatgaatgtttcttcatgaagaccgatgcaagccatgttgatccaatcgctacatttatgccgaaggaaagtcatatctgagtggtactaatttgcgagtagttgataaaccgtgggatcagcctcgcactctccggtgccacactgcagaaccgtagaaaccaggtttgcagctatcaggaaaatgaatacggccatgacccatttcccaagagcatgcgcctgctgcttgacaggtgagggttgctcccagctcttgagcagtaagagccccgagattattacagtggctgccagaacagacacaacggcccaggtatagaaatgcaggccccagagtgtcaccccatagcccggatctcccgggaggatatgcagaaacacctggcgcgaggcgatagctccgatcagcaggctccctaatagcgcaacaccgtagtgtgcgctgcgtacaccgaaacgcacattcattaaaaagccaaaaccgatggcaatcatgcccactcgttgcaggaggcataatggacatggcagttcatgctgaaacaactgataataaaaagcaattaccagcgacagacttatacccagaaccccaagaatattcagtgtatcgccaatattgagtttggaagactggagagcactgcccccagtcgaaaactgcgagcggtagtcactcatttcgccaacacctttaaaaggacaagtcaaggaggtcagttgagcgctaattgaaccacaccagaccgacaatcaataacaagccctacagacagaaccctgctcgccgtttctcaaataaaatagcagtcgcgctcagcagagcaatcaagaatggtaaaaacatatgcactatggatcttcatttacgagaagtgatacagcgctgcttttgattaaggatcaaacaagactctaaatcaatcagcccgccagagggcatccgataatctgcttgctttcatcaaaaacatgacccatcaagctgtgcacaaacactatagtgtgagaaacagaacgatgtttgacatccagcgctcttcagaaatcaatcccaggtctgggaccacccaacgctgcaagatacctgcatgtcatagcaatcctcctgatgtgtgtggatgaccctgtgtgcagtctaagttatttcctcatctctttttcaccgtattatcgtcatacattatcgattttattgataagccatttttgcatagggccatttctgccgcgaacatgacgctcgatgctgagcccactagaggtctatgccctgagcgagcatgaccgccagatcagcgactccagggatgtaaacagcaacacctacacccccatcgttagacccaaaccaagaaatcaaaccccgtcattcagccactggatgtccggcacatgacggccgccccaggcgtatgcccacgtcctggcaccgtctcgtaaaacctcaccgccatcgcgggttccgtttgcgcgggtgagcagccgagagacaggacgaactccccgctttccccttgccagaaacgccagcgcccggcgctcggcgggtccaggttccggcaggaaaacccgatctgtcccggcaccgccaaggaaaaggaaaaactgtccagggggatcgacaagccctggccgcaagccttgatataggcttccttcaaggtccaaaacgttataaaggccgacgctcgttcagcctccgcgaggccggacaggtgtcgcacctcgtggggggaaaaaaaacgttcggccagttccaggtcgaccgcccgatgccgggactccacatcgataccgacgctgctttccaaggtcagcgccagcaccacccggccctcggtatgggacaggttgaaggccatcggtacagccggcgcgacaacggccggcttaccccaggcattactggcgaacacccactgctgcggcgccacccacggcgcatacagcgacaaggtcgaacgcagcagcgcccgggtgaccaggtactgatggcgatggcgggcaaacatgaagcggcccatgcgctcggtttcctcgacgctcagccaggagcgatacagcgccagcagcccctcgtcgccaatctcttcgtcccggacgctccagacatggatatccccgggcccgagccgcaaaggccgatcctcaagcccgctcatagcggccccaggcataacaaggccttgttggcgatatgccgctccgatgggtagccgaacgcattgttgatgtaggtcaccccctccagggtgacgcggcgattgaggtggctgtgcccatagatatgggtctgggcccccagacggcgcacttgccgctccaggcgcgccgagcccagcaccggatacaggtagcgatactggggcggtacgccggccggcatcaggtctatcctaggcaggaaatgggagaacgacacgatatgccgggccccctgggtatcgggcggccggttgagctcgtcgaacacccggctcaccgcctcgtcgtcatggccgtcccactggcaggccttgaagtccatccagtggctgcgcaacgtctcgttgaacgggccgaaggaatagtcgtaccagcccagcagcggcacgatcagggtactgcccacgcgacacgcctgggtgtggaccccggcatcgcggcaggcctggctgaccatgcggtacttgtcgaaggatgagcgcaggtccgagcgaatcacccacaggtcgtgattgcccggcacgaagcacacatgccggaagcgcctgctcaactgttcgaggctggccctgagcaggcctatttcatcggcgacgtcccccgccacgatcagggtgtcgtcgaggtagtcttcgcgagacaactgatcgagccatttccagttctccggatggtcggtatgaagatctgaaacggtaaatagccgcatggaggtacctgggtaagcacacgcattggaaacagcccgcttgcgcgggcttgggcctcagacggcatcggcagccgtaaccggtgcggctggcgactccggctccgcgcgggcgcggaggcggattctcaggctgtccggcagcgcgaaggtggtgaagacctccttgatctggtccttgtcgatcagttccaggtcgaagtacttgaccagcatcgccaccgccactttcagctcgatatgggccaggggcgcgccggggcacgaacgcgggccatggccatacggaaactgctttttccgggcctctttcaaatcgatcaaggcgcgctgttcgtccagccagcggtaggggtcgaacaccgagtcccgctccagatccttcaagccatcgatccgggtcaggacaaggagcttggtgccctgttccagctcgatatcgtcgatgaccgtgtcctccaggggctccatcaccagcaagggtagcgtggactttatcctgaaggtttcttcgatcaccgcctccgtcagcggcatatctgccaaggcgtgatagtcgagctgatgcagatccaggctggcgacttcgttgcgtaggctgttctgcagggcggggtcctggccgaggaaataacacagccaactgagcatcgccgacgtggtgccctctccagccagaatcagagccatcatattggcgaacaactcatcgtcggtgagcgcgctgtcttcgctgcccacggcctcgagcatggtgtgcagtatgcaatgggggcctatatcttcctggcgacgcatgcgttcctgagtgtcgcgggcgatgccgatcaccatgctcttgaggtcggccatggagcggtcgaagcgatggtccgacggcagcttgagcacgcgccagtaaggcaccacggcccgcatgcggttgttgatggtgttgaccacgtcatggaaggtctgcagcgactggctgtcgtcgttctccaggctcttgaggtcgaaaccgaacaccagcaggcaactgacatccaccgaaaagcgccgcaggtcgtcccgcaggtccaacggctgctccagattgccgcgcaggcgatcgcgcaacttcagggcagtgctggcgatctgtggggcgaacgccaccaagctgcgcttggaaaacgccggcatgatcagccgttgctggcgcttccaggactcgccttcatcggtgaacaggctgctgaaaccgacctcatcgaacagtttggccatctctttcatacgccggaactgcgaaggccggtgcttgaggatgtagcgaacctgttcgggcttgctgaagaccacacaatgcatactagctatctgcaagcgaaatggctcgtagtgaaagtcccgcgcccattgctccagggacaggtgaaaggcgtttttgtccagttggtgcaggttgcccagcaacggcaggccacgacgttttggtagatcctttagcgttttcataactaacctcgactgcgaattgttcaatacataaaagtcggtgtggggccgtcaggccacggccccatcgctgtcgtgcagcgtgggggacgtgcctgagcgcgcagcgtcggggacatcgaggtcgttctcgacgatgtcccgcagaacctggccgacataggccgtgacctgctcgacgctctgccccggctcgataaacaggtggttgcccgggaaggccttgaaggtgaagcccgcgttgcccaggtgccgccagccctgcacatcggccgccggcacctggatatcccccaggccatgcaggccggaaatcggcagcggcaagggggccggcgcgcccggctggaaacggtcgaccatctcgaacgtggccaccagcgaaggcaattgcgcatggatcagctcacggctgaaattgaacaggccggcctgtttcatggagtactccagggcgtcgatcagcttgccgatcaccggttcggcgccaggctggcagatgtcgtccagcgagggcatccgctccaggccgtgctggcgataaacctcgagcatgtcgcggatcaccggattgacctcctggcccggcgcggaataggccgccgcgaacagatgccggggcaacggcttgccgaccgcccgtagatgctggcaccagacatacgccatcagcgccccggcactgtggccgtacagggcgaagggctggtccagttcgtcgcccaggacatcggtcagggtcgccgccagggcccacatgtcctgcagcggccgttcacgcaggcggtcgccacggttgggcagttcgatggggcgcacttccacctgctcgggcaacaacgcctgccactccttgaacaccgtgctggacaggtgggcataggggaagcagtacaggcggatccggccgcccggccgcgcctgcccgcgcagccagcggctcttgtcccgggaccagggcgcgagctgggtaaagggcgcaaacgcgctgtccgccgccggctgcgcagggctggccgcatgtgccgcctcggcgccgtttgccgcgcccggccgcacctgctccagcagttggcgcaaggtcatcttgaacaggccgctgaccgcgacctgctgatgatccaggcgcttttgcagcttgatcagcatcagcgaatccatgcccagctccagcagcgccttgttcaggtcgatctcctcggggctgcagtccagcaggtcggcaatgatcgacaacaagctgtcgccggacagcccgccctcctcggccagccgtgtctgcacggcggcggacagttcgcgattgctcgtcgccagttgctgcaggctggcgcgggcgcaggcgacccggctttccccgcggctgtccagcaccgcccaggcggtctggaagcggcgcacgccgctggccgggaccgcgtcctccgccggcgcgtgcagcagattgaccaggcgataagcctcctcccggcgcaaggggccgttgaggtagatatcctccatcgccgtggtcatgtacggcacgttctggtcgctgtcggccagcaggatcgaaggctgcaaggcggcgtcgagcaggcccgggtgggcgccaaaggcatagccgccgggctcgaaccgcgcgttcagggtcgacaggctgaagcgctcgtggaaccggcactcgtcgatggcccgcacgaagccgccggcgggaaagcccatttgcatgtaacgggcgtaaaacgccgtctcgtccagggtctgggtcggcttgcccgggttttgcaacaccgcggccaggcgcgcctgcacccgggtgtcggcctgggccatcgcggcgaagtccacccgggcttcggcggtctggatccaggcgcccggctgctgcgccacgagccggtaatcgaaccgcaggcgataagcctcggcggccaacggctcgatgctcatgcgcacctgggtggtgccgttgtgggcgatcagcagcggcgactggaactcgatacggctgacatgcagggtgctgcgcccgaagcgctcacggaacacctggtagatggcctccaggtagaaaccgacatggaaattgccggtgtcctgcaagcccggggtatccgccggcaaggtgaacagcgccgcggaagtggcgcccgcccggccctgatactccacgctcaggaacgcgtcggtcgcgaccgggacaaccgtcggcacgacggcgggcgtgacgccaggggcgccggggggcgggcgcctggcccaataggctttgagggccagcccgggccgtgggtaacgggcctggaacagccgctcgcgctccccggcgggcgctggcgtgtgccctggggtgtccgccgaggtgagcacgacgtgggcgttgaccccaccaaagccgaaggaactgaccccggccacccggcccggcccgtcccaggccagcgggcggtccggcaggcgaaacgccgcctggctcggcgccagcaacggattgatggtctccagatggttattgccgggaacccgccccaggtacaggcacaaggcggccttgatcacgctggcgatgccggcggcgggttccaggtgaccgatattggttttcaggcaaccgagaatgcagccctcgccggcaccgcgcccgtcattgaacacattgcccagggcttccatttccaccgggtcgcccaggtaggtgccggtgccgtgggtctcgacgtagccggcctgggcgggtgccaggccggcacgctggaaggcctggcggatcacttcttcctgggccaggccgttgggcgcggtcatgccgttgctcttgccgtcctggttcaccgcagagccggcgatcaaggcatacaggcgcgcctcggggtggcgttccaggtgttggcgggcatcggcctggcgttgcaggacgatcatgcccacgccctcccccgggacataaccgtcggccctggcatcgaacgtctggcagcgtcccgaaggcgacaacatgcccgagtcctgcaacagacgggtcagggccgggctcaggttgaggctgacgccgcccaccagcgcgaagtcgatctgcccgctgcgcaggtactggcaggcgatatcgatggccaccagggtcgaggagcaggcggtgtccagcaccaggctggggccccggaaaccgtagtggtaggacagccggttggcggcgatggagcccgcgttgccggtggcgatgaacagcgcattgtccttgtcgtagtcattggcgaactgcatgtattcgctggcgtactgcgcgacgaacaccccggtgcgagcgaaaccggggtggtccttgatcccggcatcctcgatggcccggtgggcattgagcagcaacaggcgctgctgggggtccatgaagcgcgcttcgcgaggcgagatattgaacaggcccgagtcgaacagttcgatgtcgtccaggtagccgccatggatgcccagcaggtcctgatcgctgaagctgtcgttcaggcccagcaggtcgcgccgggccctggggtagtggccgaccccgtcgaagcctgcgcacaactgctcccagaagcgcggcaggtcgggcgcctgggggaactgcccggacatgccgacaatggcaatcgcggcgttatcctccaccggccgggtaaccggcgacgggccgatggccgccggcgccggttcgcggcggtcgctcaacgggcctggctcacggttggcggcgatgtaatcggccagggcgcgaatcgtcgggtaacggaagatcgccgacggcagcacctggtaagccaggttctgggacagtgtggagaagaacgccagcgagttgaccgagtccaggccgatctcggcgaaggtctggtccggatggatatcctccagccccagcagccgttgcagctcgtcacgcagcagcgcagtgaggtcgagggtttcgccccgcgaggcctggacgctcgccgcggcctgtgccgcgggcggctggcgcaggcgttcacggtaatgggcaaacaccggctgggtccggatcgccgggttgatcgcggcgaaccgctcccagtcggcatcgaacacaatgcattcgtcgatggcattggccaggatgcgttccagcaacctcaccccttgctcgggggtcagcatgcgcatgcccagggcatcgaagaatgcccggtgattgtgcgccaccgccatcccggcgccgtcccagtcggtccactggatcagctgcgccggcaagcgccgttgccgacgctcggcggcgaaggccaccaggccggcgttggcggcgctgtaggcgctcaggccgttgccctgcatgccctccaccgccgagatcgacgaaaacaggcagaaataacgcagcggatcgcccagggtgaggcgttccaacagttgcgcgcccaccagtttcggccgcgcgacgtcggccagcagggtcgccgaggtcgcctggatgggaacggcttcggtggtcacgccggccaggtggaacacgccggtgatcggcccgccgaggatcgggcgcaagccgtccagttgccgggccagggcggcttcgtcggtcaagtccgattgcacgtagtgcagccgcacgccctgctcacgcgccaggctgtcgatcaatgcctgcacggtggtgcctgcgccgaggctcgggtgctgcagcggcgccgacagcggtttacggccgatgacgatcagcgatttcaagcctttgctcaccagccagcgcagcaccgtcacgccgatcccgccaaaaccgccggtgaggatcatgctgcccgacaggtccaacgccgggtccgccgcggggccacggggaatggccagcggttgcaaggccggggtcaggcactggccgtcctgccagcgcaagcgcaggtgcgcctgccggcaatgcaggtgccggaggatctgctccaggcgcgcactgtccaggctgtcggtgtccagcaccaggctgccgatttccgggatctcgtagcgcaggaagctgaagtacttcgccaggctttcctgaatcccatcggtctggctggcctgggtcaggttcagcagcaccagcttcagacccttgcgggtcgcggccaggccggccagcgcccgcacccgttgggtcaggacgctggcctgttgggcgaagcgtcgatccagctccgccccggacaaggtcgacagcgccgaatacggctgcagcagcaccagggtgtcggcctggctgtcatcgatcagttgcgcgatgcggcgctcgtcgaagacttcgctggacgtcgtgacgcccggctgcgacgcccagggttgcagcgtcgcccgatcctcgccgaacaccagcacatggcgcggcgcgccgtggtcgggatcgaccggcgcctcgacccagtgggtctgcatcaaccagtggtcgaggttgtccgcgggcatcgcgattgcgctcgggaccgggctctggtccaggcccgccagttggtcggcgatccagtggcgccgggtctggaacgggtatgtcggcagcggcacgcaacgcccggaggtcgcgttccccggccattgcacaggcacgccgacgacccaggcccgggcctgcccctgcagatcgtcggcggccggcgtggccggagcgccggcgccacggtccaggctgtcgccctggtacaggccgggcagcgcgccgctgtccggccgctccagccaggcccgcaggcgcgcgcgcgcctcttgacggtcggccgccaccagggccaggcgcaaccgcaacgccggccgatgatgcgcgagggtcaaggcgatatcgctcaaggcgtgccggtcgttggccggggcctcgagaaacgccagcaggcaccgggcctgctcttgcagcgcagccgccgcctgggcgctgagcagcagcacgcaggggctgtccgcggcggctggcagggtgaatgatggagccgcggccgcgggggcctgctccaggatcatatggacattgaccccgcccgcgccgaacgaactgatcgccgcacgccgaggcagcgccctgccctcgcgctcgatcaccggccacggctgcgcccggtcggggatatggagcccggccctggcgaagggaatatcgctgttgagcgggccatgcagcaggctcggcaccagggtggcgtgctgcaactgcaggacggtcttggtcaactgggcgatcccggcgctggcctcgccatggccgatggaggccttgaccgaacccagggtccgcgagacaggcgcagcggcgccagtcacataggcgtcgatcagcccctggatctcgatggggtcccccagggccgtgccagtaccgtgggcctcgatgtagttgatggtgtcccgggggacgccggcccgagccaacgccgcattgatcgcctgggtctggctgagcgggttgggcacggtaaagccctgggtcttgccgtcgtggctgaccccgctgcccttgatcagcgccagtatccggtcgccgtcgcgcagggcatcggcgtggcgcttgagcagcaccacccccaccccttcgctcggcacataaccgtcgccgccggcggcgaatgcccggcagcggccatcgctggcggcgaagcccgcggcgcacaaggtgaggtatttgctggggtgcaaggtcaggttcaccccgccggccagggccgcctgggtttccccgttgcgcaggctttcacaggccaggtgcaaggcgtacagcgacgaggaacaggccgtgtccacggtcaggctggggccggtgaggttgaagaagaacgacacccggttggccacggaaaaggtttgcgatcccgccggatagaacggcgcgcggcccttgagcgcatcggcccccaccaactggtagttgttgacgctgaccccggcgaagaccccgaagtcccggggtgtggcctgccagcgcggtgccaggtagccggcgctttccaggcaggtccaggccatttccaggaacagccgctcctgggggtccatgaacgcggcgtccgtggccgacacattgaagaacggcgcgtcgaactggctgatgtcccccaaaaaaccgccccacttgcagtagatcgcatccgggcggcctttcgcgcccggggtgaagatcgagcggtagtcgaaacgctccagggggatttccgtcacgcaatccacgccatcgcgcaagttctgccagaaggcctccagggtctcggattgcggataacggccgctcatgccgacgatcgcgatgctgtcgtcggcgctcgacggctggctggcgaccgtgcccgacggcgcggcagcggggaccggctcgcgcgcctcggcctcggcctgagtcggcaccggcaaggccaggcttgggcgcgcctccaggtacgcggcgagttcgttgagggtcttgtacttgtagaacagcgtcgcgtcggtttcgccggtccaggcgctgacccgctggttgagcttcatgatcatcaccgagtccaggcccaggctctcgaaatccccatggggatcgaggcgctcggggccgatgccggtgatctcgaacaacgcctgggccaggcgctcgaacgcgctggcccgggcttgcggctcggtcctggccgcgatgaccggggccgcttgggccggcgtgaccaccgcgctcggcagcgccgcggcctcgaaccagtagcgttcctgggcaaagggatagcccggcaggctgatgcgccgcggccggtactcctggttgcccgcgggccgcggcaacaggcgccagtccagtgccgcgccctgggaccagaagcgcagcacttcatcgaaacgctgctgagcgagccaggcgttcaccagcagctggacatccgcctcggccagttgcccctgcaacgcctcgcctcccgacgggcgctcgcccacgaacacctgctgctcgcgcaagcgcgccagcgccggagcatcgagcgcctcgaccgcgagaaacagttgcagtttttccgccagctgcgccagggaatccacccacagcccaaggcgatgccgatggacctcgcgcccggtttgcaaggtgaacgccatgtccgccaaccggcgacgggcgtccgctgccgtcacctcgtccagccaggtagcgacccgggcgctcagggcccgggccaggcgctgcaactgcggctggctggcggcggacagcgggatcaggaaggcctgggtcgagacctcgcgtgggtcttcggcctgcaggtactcctgcaacaccacatgggcattggagccgccggcgccgaacgaagacaggccggccaggcgcggcagggcctgtccctggtgccgcggcgccggccagtcgcccagttgctgctgcaccacgaagggcgaggcggcgaagtcgatccgtgggttgagggtcgcgctatgcagcgaaggaaccagctgccggtgcttcatctgcaacagcaccttggtgatcccggcgatgcccgcggcgctttcgcaatgcccgatgttggacttgaccgaaccgatcccgcagaactgccggtcgtcggtgtggggccggaaggccgcgctgagggcggcgatctcgatcgggtcgcccagagcggtccccgtgccgtgggcctccaggtagctgatatgccgtgggtcgatgccggcccgcccgtaagcgcgggcgatgacctcggcctgggccttgaccccgggcaccgagtaaccggcggacttgccgccgtggttgatctcgcaggccttgatcagcccgtagatagggtcgccgtcggcctcggcccgggcgcgcggcttgagcagcatggcaccgacgccctcgcccggcacatagccgtcgccgccttcgccgaaggcctggcaacggccttcgctggaaacgaagcggccctggcccagcatcaggtatttattgggatgcagcgacaggttcaccccgcccaccagggcgctgctgcaatcgccccgctccagggcgcggcacgccaggtacaaggcggtcagcgacgacgagcacatggtgtcgacggccatgctcggcccggtgaaattgcacacgtaggacacccggttggcgatgctcgaagcgctgccgcccagggccatgggattgcccagcaccgtctgctgcgcaccgtacaactgatactcctgatacatcacgcccacgtagacccccacctcccggggcaggccctggcgggtgtagccggcatcttccagggcatgcaccgcgcactgcaggaacaagcgttcctgggggtccatgaaacccgcctcgcgcggggtgatggcgaagtagaaaggatcgaactggtcgatctggtcgagaaacccgccccagcggccataggtcttgcccgggcgatccttgtccgcgtcgaagtacaactcgtggtcccagcgctcggcgggaatgcgggtgatgctgtcgacgccctggctcagattgcgccagaactgctccagatcgtcggcccccggataacgcccggccaggccgatgatggcgatgtcgtcctgggccggcggcgcatcggccgccggacgggaaaagtcggcattgctcaagcgggccgggtcgctcacctgcctgaccgacgcattgacgacgctggccaggtgttcgccttcgggcgacaacacatcgacgtcaaacgcgatatagccggccttggccgtgcgcaggcgattgaccaggtaaaccgtggacggcaacggcctggcctggacgatgcgttcgatcagcagcggcacatacatgctcgactggggctggccgaagtccgggtcgtggaagaaaaaacaaccgttgagcaacagcgggtcgaaaccgtagtgcaggcgcccgcccttggcctggggcgagccgaggtcgaccttgctcaccaacagggtggcgccgtcggtgtaagcctcctggatgttctgcaacaacggccccacggtgaattgcgggatgcgccggtaggactgctcgatcgcctcgccggacagccgcgtcagccccgacaacaggccggccagcgattgatggcgggcgtcgaaccggtccttgaggcgcagttgccccacacagcacggctcgatgccggccccgcgctcgcgctggaaaccaacgctgaacgcctcgcgctgcggatccagggtgaccgtcagttccaccgactgcccggcctgcaaggtaatcggcccccccagcaggcggatgtgccccaggctcagcggaaagctgtcggccccccactgctccaggcaggcctcgatggccaggcacggatgggtcacacccatcaaggccggcgtgcccagtaccaggtggtcttgcaggtaggcttcttcggcgacgaagcgctgggtccaggccgcgcttgcctgtattgccggggccggcgtgggctgcgccgctgtgcctggcgccgcgccatagtgctgctggaagaatgcccccagctctcccagggtggtgtgctcgaacaacagggtcggcgacagctcgaggcccagcgcctggctggcattggccaccaggtccagcaggtccgccgaatccagccccagctcgtaatagcctttgtccagggccacctgggacgcgctgatgcccagcttgtcggcaatccgccgacgcagcccctgtatcaccgggtgttcgctgccgtcagccggcgccggcggcgcggccggcggttgatgcaggccttgttcggtacgcacccgcttggcagtgaagcgttcgatctgcgcgactttctcaccgctgtcggcaaagaattccagggtgaagaccaccagttcccgctggacgctgaccgagtcggccttgatccgcacccggcattggccagtgatcggcgccaccgcgctgaagccctggaacagcagcggcaggtacaggctttcgggcggtgccgaacgctcgccgtcgctcagctccagggcctgggaactgatggccgcgccatcgagcagcgccgggtgaaacagaaaccgcccggcatcgggcaacgcctgcggccccaggctcaggtcggccagcaacccgtcggggccggtaccgatgcgcccgcgtacctgcaggtaatcgccatgctccaattggtggtcgcggcactgcccatagagggcctgcggggtcacctcccgagtcgcgccagcgctcccgggcgccagccattcgccgggcgcgaacactgtcgcgccggtgtgttcgagttccgccgtggcatagggccgggccgggccttcggcgcccaggtcctcgaccaccagggtgtaataccccggctcatcgcaaaacagcgccacccgcaccgccaggctgccgtcggccccctcgagggccaggggacggtggatgcgcaaggtctgcaagcggtgttcggcaaaccccaggccatgcttctggcagatctgataaatcaggtcgatataggccagcccgggaaataccggacgcccgtgcacccaatgggcgccgatcacggggttggcgcaagacagcgaaatcttgctctcggccaatagagtgcgcatcagagttgctcccagatcatagaggtggcaggcgcgttgtcgcgggccaccggtaacggttccatagtcgccgccagcggcgcatgcccctggcgctggcggtgcaggatcggcgcggccaggggctggcgccttgcgggtacggtcggtgcttcggggctctgcaagatggcatggacgttgttgccgccatcggcaaagcaattgagggcgatccgcaacggccgtccctcgggcaacgccactgcgttgcgcggaaagtaaaaggccgatcgctcgaggtcgaagtggcgcaacggctgctgccccgagaggaacggcaccaggctgtgatgctggatcatcagcaccgccttgatgaaactggcgatgccttcggcgcacagcggatggccgatgttcggcttgatcgaacccagcccgcagggactgtcggccgaacgcccgctaccttcgccatggccatacaccgcgtcgatggccttgagctccagaaggtcggtgacctgggagccggaaccgttgacctcgatgtagtcgatctgcccggcggccaggcccgactggcccagggccttgcccatcaccgccttctggcgctgcacattgggcgtggccgggccggcggtgcgaccgtcgttgttgctggccagggcgctgagacgggcatacacggtatcgccgtcctcgcgggcccgggcggcggttttgagcagcaccaggccgacgccttcggacaggacgatgccgtcggcccgttcatcgaacagtggaactgcccgccgtcgctgagcagcccgcgctgctggaacaagccatgggtgcgctcgccgtccagcaggctgaccccgcccaccaccgcggcgtcgatctcgccgctgcgcagggcctggacggccatgcccatgcccaccagcgccgaggaacaggcggtatcgatcaccatgctcgggccgctgaagtcgaagaagtgcgaaagattggccgccaggtagttctgccccgccaccacgatagggttgcgcgcctggcgcagggcctcggggtccaggctgctgcgggcgcgaccgcccaggtacacgccggtggcgctgccgcgggtttcctcgacccgatagccgcgtgggcccacaggttcaggcactcctccagcaccatcagggcctgggggtccatggcgtggaagtcttgctcggggatgtggaacgtctcgcggtcgaaatgatcgcggttgtccagcgtgccgctctgccagcgttgcgagggttccggcgacaaggcgctgcggccctccttgagcaggcgccagtagtcatccaggctggccgccccgggaaagcgcgccgacaggccgaccacgacaatttcctccgccccggtgccatgcgcgaccggccgcgcttcgactgtcggcgccgatagcctgggcgccggcgctacaggcgctacaggcgttaccggcgcggcggcggcaaatgcctgggccagggccggtccctgatgggccagcagccactggctcaggtcggcgaggttcgggtgttcgagaatcagggacggcgccaggtcggcctgcagccgccgattgatggtgcgcaggatctgcgccatcagaatcgaatccaggccgtagttggcaaagtcctggcgcgggtcgaaatcctccggggcgatgcgcagttcgccgcggaacaggtcgcccaaccagcgctgcacctgatccgcgagggcagcgtccgggacggcgggtgccgccagcacgggcgccgcgctgctctgcggcgggatctgcggcgcctggggcggcgcggcccgcagccacagctcggggttgaaacaggccggcaacagcaccccggaccgggcgctggccagcgcccggtccagcagcgccaggccgtcccggtcgctcagccccaacaggccggtgccgcggtacagctcggtgtccatggcccccatgccggtgtcggtccagctcggccattgcaggctgagtaccttgtcggcctggtgctgcgcggcaaaggcgtccatgtaggcgttggccatggcgtagtcgatctgccccgccgccagctcgggcaattgcgcgctgaccgaggagtagacgacgaacagcgacagcggcgcgccctcaagcgcccgatagaggttgtccaggccacgggtcttgggcgccaggacattgcgtacatcggccagctgtttgcggatcagcgccgggttgtcgtagtcccccaggcccgcgcagtgaatcaccccgcccacgggccccaactcgcggccgatctgcgccacggcctgctgcatcgctcgggcatcgttcatgtccaccgccagggtcaacagctcgacgccctgctgctgcagggccgaaagcgccttgagcttctcctgcagcgcgctggccgggtcggccagcagcgctggccattgggccggcggcggcaaggcttcgcgaccgctgagcaccagcttgcgcacgccgtagcggctgacgaagtgctgggcacacaacagccccaggccccgggtgccgccggtgatccacagcgcttgcccgccgggcaggctgaaggccggcccggcgacgcttggcgccaccgcccgcagcgcgggcaaataggcctggccggcgcgatagcagacatgccgttcgtggggcgtgcgatacagctgctcgatgatctgcgccaccaacagcgagtcgtcggccgccaggtcggtgtccatgtggccgctgcgcaagcgctggtactcggcgcccaggcagcggtacaggcaggccgggaccgccgcctgggccgcgggcgccagggacgccgggcgctggaaggcctccaggtaacggctgacgtaaagcaggcggatatcccgcaggcgcgtctgctccaccagccgttgcaggcccgcgaaccagccgtccacctcggtggcgcaatgctcgacgaaggccgggtcgtagccggtgatgtccagcaccccatgcagcacatgcccgttgggtttgcacagcagttccacgcgctgggccagctcaaggatcggcacgatccgcgtcgcgtccaggcgcgctgccaggcggtccgccagggcctgggtggcggtggtgcagatgatcagcacgaagcccggttcgcgctgcggcgcagctggcgtcgccgctgccgggcgcagcgcccagtgctgttcgaacagcccgctgtgcgccgctggcacggctttctcaggcgctgccggacgctcgccgcccgctgcaagcccggccagccagtagcgctcggtcttgaacggataggccggcaacggcaggcgccggggcggttgggcaaagccctgccggggcccgtacaagcgcgtccaggacggcgccacgcccatcacccagacccgggccagtgccggcaggttggccttgtccagccaggtctgcagcagctgccgggcatcttcgtcccggtacaggtcctgggtgtccttgccctggctggccgaaccgcgctgccagtgcgggtcgacctcggcggcagccaggctgtgcaggcgcgctttcaattcgtcgagggaggcgaccacggtggcggcgcgatgctccatggcttcgcgccccacttgcagggtgtaggccaggcttggcagcgcatcgtcgcccagctgcaggcgctcaatggccgccagcaggttgccggccatcagcggcagccgcgaggcctcgcgggccgacagcagaatcaggcaggcagccgcaggtctagcctggaccggggccgacggatagtcctcgacgatggcgtgggcattgacaccgccggcgccgaagctgctgatcccggcgatgcgccggccctggcccgccttcgccggccagggcgtcagttgctgattgacctggaacggggtcagggaaaaatcgatgttgggattcagcgtccgggaatgcagcgacggcactatgacctgatgccgcatttgcagcagcaccttgatcacccccgcgaccccggccgcgccttcgcagtggccgatattggacttgaccgagccaatcaggcagggcgtctttcggggttgcgcgggatcgtggccgaaagccctggtcaggccgctgatttcgatggggtcgcccaaccgggtgccggtgccatgggcctcgatgtagctgatctcgtccggcgccaccgccgcccggcgcaaggcctggcggatcacctgggtctgcgccgagggattgggcacggtgtagccgctggcacggccgccgtggttgaccgcggtgccgcggatcaccccgtagatgaaatccccgtcgcgctcggcgtcctccaggcgcttgagcagcagcacgccaacgccttcgccgggaatgtagccgtcgccgccctcgccgaaactctcgcaatggcccttggaggaaatgaactggccctgggacagcatcaggtacttgctggggtgcaggctcaggttcacgccgccggcgaaggccgtgtcgaccgccccagaacgcagggcctggcaggccatgtcgagggccaccagggagcttgaacacatggtgtcgatggccatggccgggccgttgaagttgccgacataggccatgcgcgtggccaccgaggaagtgccgccgcccaggcccatgggcgccgcggattgtgcggcgaacagcgggtactcctggcccatgacgccggcgtagatcccgacattggccgcgccgccccccgcgctgccgcgctgcaaggcttcgcgggtgtagccggcgtcctccatggccatccaggcgtgctgcagaaacagccgctccagggggtccatcacttcggcttcccggggcgaaatctggaagaacagcggatcgaaggaggtggcatcgtcgataaagccgccccacttgctggaaatggtccccggctcgccactgtcgctgtagtagtcgcgccagtcccagcggctggccgggatctcgctgatgcagtccttgcccgcttgcaggttctgccagaacccgtcgaggtcgtaggcctgggggaagcgcccggccatgccgatcacggccacccgatgaccggcccgggccgcacccgtggccgcgtccacctgcgccggcaggctcggttccaggcgacgcaacgaggcattgaccagcgacgccagcgcccgtccctcagcgtcgacgatcagtgagtcgaaggcgatgaaaccgtccttgacccgcttcggcccggtcaccacgaaggccttgctgcccgcgtggcgccacagcgtcaggcgctcgatcagcagcggcacgaaggtgccggacgggctcgacggggattgctccggggcttggaacaggtagcagctgttgagcagcagcgggtccagggccaggccgtcgacaaaggtgcgccgagtgtcgtgcagctcgacctcgcagatcaggctgccgtcggcaccctcgtaggcggcgaccagggtcttgagcatcggccccagggcaaaggccggcaccgcgcggtaccagctgtcgatctgctcctggttgcacggccgggccgcgccgatcaacgccttgagatcgagggcggccggctcggcgggttccggcggttgcaggcggccttcgcagcacaggctcgcgccctccccggccaagcgttggtgcgcactgaagccggcgttgccatcggtatccagacgcacctccacctcgaccgtctgccccggttgcagcttcagcgggccgccatggaaacggatgtcctgcaggctgagcggcaagcccgccgcgctggccaatgcggtttgcagcaccaggctcggataggtgatgcccatcagggccggctggccatccacccggtgatccagcaggtacgcctcgtcggcggcgaaacggtagaccgcagctgccggttgccgcacggccgctggcggcgcgacctggggcgccaactggcggatatggttcagcagctcctcgacggtgttgtgttcgaacagcaaggtcgggttcaggcgccgggccagcaactgctcgatatccttgaggatggtcagcatctgcgccgaactgaggcccatgtcgaaaaagccgcgcagtgggtcgacctgatcggcgcgggtctgcagatgccgggcgaataccgccaggatatccggcgccaggtcatggctcggcgccccggcagccggagcgcccagcgttgccctgacgcgcttgccggtcagttcgccgaggctggcgacccagcggcccgccaggtcgtagaagtcgatgtccagcttgcggatgtcgttggccgtggtaatccgggccagctcgacgcgggccacgcaggcctcctgcaacagggcccgggcctggaacgcgccgtagtgcaaaggcaggtacaggccatcgtcgccggcgggcagctggtcttcgagcaccgcggaggccacggccgcgccatcgattagggtcggatgaaacaatgcatcgggcatcagttgccgccactgcggcgccacgcccagctcgataaggcagccccaggcaaaacgatggacgctgccttcggccagcagcagcccgtcgtgcaccagctcccgctcccgcgcccgggcatacagcgcctgcagcgggacctggctgtcggcctcggccctgagggcggccaggtccaggtcgggcttggcccccgccccttcgagcgtcggctgcaagcgcgcggtgcagtacgtcaccctcgcccccacgacagcctcgccttgcagcgccacgccatcgacgtccacgacccaggcgtcgtcctcgcgctgcatcgccagggtcaggcgcagcgccgaaccggcctggacgatcagcggctggtaaatcaccaggtcgcgcacctgggtgcgcaggcaatcgagccccaggccgtcgcgggccacccgcagcagcaggtcgatatacgccaggcccggcaagaccgcctggccctggacgcgatgccgggccaccagcggatggtcggcgccgatcgtcagatcaaagtacttgttcatgaatcacaccccagcttgacgagatagaagaaggcgcgacggccgctgccacggttgcaggttcgacctgggcaacgggggccggcgcgtggtcgcgatggcggggaaaggtgcggcgctcgaacgccggcgccggcaacggctggcgcactggcacgtaaccgggatcggcgacgaactcttcgaggatcacatggcaattggtgccaccgtccgggaagcagctctgggcggcgacccgggggcggccgtcggcggctttccagtccagcgtgcgacggttgaaatgcacccgcgaagcggcgaaatcgaagtgttcgaaaggccccaggccgcaggcgctgggcacgatctgccgatggtgcaggctcaaggcgcagcgcacgaaaccggccagccccgaggtcagcagcagatggccgacgctgggtttgaccgagcccaggcagcaggcgtccagggccctgtcgtcgagttcatagacctgggccagcgccttgatctccaccgcatcgaccaccgccgaaccgccgccgttaacctcgatatagccaatgtcccgcggggtcttgccggcctggcgcaaggcttggcgcatcacctcctgctgcgccttgaggctgggcgaacccggccccagggtgcggccgtcgttgttcaccgccaggcccttgaccacgcagtagatgcggtcgccgtcggcctgcgccgcgtccagggtcttgcagaccagggccaccaccccctcgcccagcacatcgcccgcggcacggtcgtcgaagatattgaaggcgccgtcggggctgaggatattgcgcgccgagaacaggtcatgggcgtcggacgaagtcaacaggctggtggcgcccaccagggccatgtcgatgctgccgttgcgcagggcatcgaacgccagagacatggcggtcaggcccgaggaacaggcggtgtccaccaccaggctggggccggtcaggttgaggaaacgcgacaggttgctcgccaggtagttctgccccacgccgaggatcgggttgctggcctcggccagcgaccgggcgtcggcggtgacccgcaggcggccgccgatatagacgcccaccggccggcccgacagctcccgctgggaataaccggcgtcgaacagggctgtgacgccttgctccagcatcaggcgggcctggggatccatcaccgccgcgtccttgggattgaggccgaagaacgccgggtcgaactggtcgatagcgtccagccagccgccatgggcctggccatgccctcccggccagcggtgctcgcgcatcgggccgatggccgattcgccgcgatcttgcagggcccagaacgcctgggcatcctcggccccgggcaggcgcacggccaggccgacaatggcgatatccgctgaccgggaggcttcggccgaggctggagctgggaccgagactggagctggttcaggttgcgccagcggtgccggttcagggctttgctccaggaggcccaggtgccgctgcagcgcctcggggtaagtgcctgccaggtgctcgcacaggctgcccagggtggtgaactcgaacatcagcgacgggtccagacggttgcccacccaggcgccgaggcgctccatgagttgcaggaccatgatcgactcgatgccgtagtcgacgaacgccatgtcccgatccgtcagttgctcggccgagaacttcagttcctccatcagcagttggcgcatggccgcttccagggcggtcagcaacggcgccggggcagacggggtcactgcaaccggcgccggtgcaggctgggccgcgacgggaagccgggccagcccggccgggctgaagcgctcaaggtcgacatggcaaggcaggcacagccccgggttgtccggcgacagggccagggccagcacccggtccagcaggcccaggccgaccgtagtactcagggacttgagccccagctgcgcggccagtggcccgctgttgcccacggccatgccgacttcggcccaggccggccattgcaccgagcacaccccgggccgggcgttggccagggcgaactgatccatataggcattggccatggcgtagtcgccctgccccgacgccagggccggcacgctggccgacaccgaggaaaacatcaggaaaaagcgcagccgctggctgtccaggcgctggtacaaggccgccaggccggcgattttcggcgcgcacacggccgccatttcctccagggtcttcttgatgaaggccggtgcggcactcaccgatccggcgcagtggaagaccccggtaacaggccccagctgccgttccagcccatcgacggcctggccgatggccgctggcgagtccagctcgcacgcctgataggcaacccgtaccccctgctccagccagccttgcaggcggcggatcctggccagtacccggccgtcgaggccgctttcagcggccagcaggcgcggccactgcccggcgtcgggcaacggctcgcggccgatgatcgcgatggcgcaagcccccgcctggatcagatggtccaccagggccgcgccgatcccgccggtgccgccggtcaccagcagcacgtcgtcggcctgccacgacggcgccgcggcggcgctggttgccagcggctcgaaggccgcgacaaaacgctcgccctggcggtagcagcagtccgcctggagcccggcatcgaactcagcctcgatctgggcaatcagcgcgggctgttgcgacaggccgaggtcgctgtccaggaccccggcccgcacgctgcggtactcggcatcgagcatgcggtacaggccggcagtgcgcgcgccctgcagcgtcggttgcagcttccaggggtgcagaccgtgggtcaccagcaacagccgaggcccgtgctggcgctgctcagcgaggaaggcctggagcagcgccagcttgccgcgttcgagggcggtgctggcttcatagccgctatcgagggccgtcaggtcgatcagcccggccagtggacccggacagcagcgataggccgccagggcgcggtccgggtcatggaaatcccccccctgctcgccctggtgcaccaggtagtgtttgtccacgccactctccgcgaacaggccccgggccagggccagggtcggctcggtacacaggatcaacagcgcaccctcggccgcaggcaagtccgcgcgccccaggggcgcggcttgccagctgcggaccaggatcggctggtccgccgccgcggcgggttgcggtgcgagcgcatcccggcccaggggtgcccagtagcgttccttggcgaaggggtacagcggcaggccgatgcgccaggccgcggtgcccggctgcagtgcagcccagtccagcgtcgcgccttcgacccaggcccgcaggtgcgcctccagggccgctccggccacaacagcggcaggcgccgtacccgccttggcccggtagaacaccccggccccggccggttcgtgccacacaccgacgccacttgcggcctcgagctgcgcccagttcaggctcaggctctgcaagcgtgttgcgagtacctccagcgagtcggccatgaacaccagccgctcgcgcatggcttcgcgcccgacctgcaaggtatgggcaatgtcggccaggctgcgtgggcggccatcggccagggcctggcgcaactgctccaccttgtcccgcagttgccccggcgtgcgggccgacagtgggatcgcccaggcgctgccgtcgtggctggcagacacgggcgcggattcgccctgcgtgggctcgcgcaggatcaggtgcgcattggagccgccggcgccgaacgaggacaccgccgccacccgcgccgcgcccgcggccacctcccagtccgccaggacctgctggacccggaacggcgtgccggcaaaatcgatattgccgttgagcaccgccgagtgcagcgagggcaccagttgccggtgctggaattgcagcaggatcttggtcagcccggcgataccggccgcgctttcggcgtgaccgatattggacttgaccgaaccgatggcgcactgccggtcttcctgcgagccggtccccagcgccttgctcagcccggcgatctcgatgggatcgcccagggccgtgccggtgccatgggcctcgacgtagccgatggtgcgcgggtccaccccgccctgttgcagggcggccttgatcagcgccgcctgggcattggggttgggcaccgaataaccgttggtcttgccgccgtggttgatggccgaagcctggatcaccccatagatgcgatcgccctgggccacggcatccgccagcggacggagcaacaccgccccgacgccttcgccgggcacatagccgctgccgccctcgccgaaactgcggcaacgaccgtcgtcggagaggaagcggccctggcccagcaccaggtatttgttcgggtgcaccgtgacgttcaccccaccggcgatcgccagcgcgcattcgccggccagcaggctctggcacgccatgtggatcgcggtcagcgaggatgaacacatggtgtccagggtcacgctggggccatggaagttgcagaagtacgacacccggttggcgatcgaggcgacgttgccgggaatcgccagcggatggccgagggccgtttcctcggggccgtagagctggtattcgttgtacatcgcgccgacgaacaccccgacggcggcgctgtccaggctatgggcggcgctgtgttcgttactgtagcggcgcgccgtggcggccagggccgcccgggtgtagccggcatcctcgagcaggtgataggcgcattgcaggaacagccgctcctggggatcgaggatctgcgcttcgcgggccgagatgttgaaaaacagcgtgtcgaagcagtccacatcgtcgatgaaaccgccccatttgccgtaggtggtgccggggaggtttttctcctcggtgtagaagcgctcgtggttccagcgctgtgccgggatcggcgtgatgcagtcgcgcccctgccgcaggttgtcccagtactgctgcagatccgccgcctgcgggtactggccgctgagcccgacgatggcgaactccatcgggccggcggcgggcgccggggtcgccggcgccacgttcacggcgacggccggaatgccgggcgcgacgacaggcgcagccgggttcaggcgctgcgccagttcttgcccatgctgttcgaggaaatagctgcagagtttctccagggtctggaattcgaagaacagggttttcgacaagggcccgaacactgcttcgaggcgggcggtcaagcgcccgaccatgatcgagtcgatgccgtagtcttccaggggcgcccggacatcgatccggtgcgccggcagcgcgaacacatcgcagagcagctgcttgaagtactgctggacctgctccgcggtcaccgccgcggcctgcgcggccccaggcggctcgaccggctcgaccgccgcgcggggcgtcggccccaggccaaaaggcgccagcgcccgggacgggtcgccttcggccaccagcacctgggtcgcgccttcggccagggcgctgcgcaacgccgccagcgccactgcggtactcaggggacgaatacccgagtaggtccacagccgttcctcggtcccggcgtcggggcgcatgcgcccttcggcccacagcgaccaatccaccgccagggtatggccctggcgttcgccgcggcgcacctgctggttgcgcacataggcaaaaccgtcgaggaaggcattggccgccgcgtagtcggcctggccgacgttgccggtcacgccgctggccgaggcgcagagcacgaaccacgcaaggttcaggttgcgggtggcgtggtcgaggttggcggtgcctcgcaccttgggttccagcaccgcggcgaactgcgcctgggtcttgttgacgataaagtcgtcggcggcgatgccggcgttatggatcaccccgctcaggggaccatgggcctgttgcaccgaggccagcaaggcttcgacttccgccagctggccgatgtccgcctggcagtacacgacccgtgccccgcgctgttcgaggtcggccaattgctggcgctcggcctcgcccagcagcgagcgccccaccaggacgatgcgcgcgtcgcggctgttttcgataatctcccgggcgaagatccgccccagcccgcccgcgccgccggtgatcaggtagcaaccggcgtccttccacaccggccgttgagcggccggcgccgcgccgcggttccagaccggcacccgctgttcgccaccctcgagccagaccgccgagtgctcggcgccgatctgccccggctcgaacccgtccaggctcggcatggcgatcagttgcccgcgcagccttgggttttccaggcacgcggtcttcagcaggccctcgaggccgagcatgaccggcgccgccggccagccgagcagcagcacctggataaacagcggctgctggccggcgccggcccccaggcaagtcttgaggtgggcaaacaaggcctcggccgccccctggtaatcccgggccagggcctggttgtcctggccgctggagcgcaccgccagcgcctgcacctgcgcctggggaaacagctggccgaggcggctggacgccgccagcgggtcgccggccgccagcaacagcagctgatgctggccgtgcgcccgcggcgcggcagtagcggcggccaccgcttgccactggcgcagcaggcggatcggggccaacgtctcgcgcccgcccagggcgatctcccgcgcggccaggctgtgcaggctcacccgcaggtggccctggtcgtcgtacagccgagcgtcgagcttgctcacggccccctgggtatcgaggctcagcagcgcccacatcctggcctcgagagcgccgtggatatccaaccgctccagggcgaacggcactttcggcggcaggctgccggtgccgtccgcgccgaggaagaaccccgccgccccttgcagcgcaccgtccagcaaggccacatgcaaggtccagccgctcgtggactggctacccggcgcctcgggcagcaccaggcgcaccagacattgcccggcatcgcagtggaccgcctcgatcacccggcaagccggcccgtaggccagccctgccgcctggaaggcggcgtagcagtcggcgcccgacaggacgtggctgctgcgcgccttgagcgcctggatatccagcacgtcgggggccgcgaagtccccggccagggcgctgtcgaacagcgacaccacgccctggccgtgcacggtcggctcggccgtcggctggtccgccgcgcgactggcaatgctgtaggcaaagctgccggcgtcggccagcggggtcagccgggtttccacctgccgcgcctcgtcggcgtgccaggtcagcggcgccatccagccgaccttggccaggcgcgcgcgggtccagcccgattgctgcgtggcggcggcttgcagggccatttccaggtaggccaccccgggcagcacgtgatgcccttgcaccacatggtcggccaggaagaactcctgcccggtaaacgccgacacgaagcattcgccgccggcctgcgagccctggtgccgcagctgcactaacgactgggcctgggtcgcaggcgccgccgacggcgtgccgcggccggggccctgggggtcgatccaatagcggccatgctcgaagggataggtcggcagtcgcaggcgcgcgggcgcctgccgcgggtaacgcaaatgccagggcagcgcgtacccctggcagtagaaatcggccaggtcgcgcagggtctcctcgtagccctcggccggggcctcggtggccactgcctcgggcgcaaggtcgtcccccagttgccgcacccactgctcgatggtgcgcacgatggaaggctgcggcgcctggcgcttgtcgcctttgcccagcagcacccgctcctggaacacctgtgccgggaaggtatcgtcgctggccgcccgggcccgtgcctggagcaggtagtcgctggccagttggcgcagcaggctcagcgccgaagcccagtcctgcaccaccagggcgcagcggtattcgaagtgatggcgaccgtccagcaaggtgtggctgaccgcggacaagtccagttgcgggttgccggccagcacctcgatcaactgctcgacccggtcgcacaacgacaggatcgaacgggccgacagcaccagcaggtacgccgccgcggccttgaagcgctgcggcgggcggcgctcgtcgcccgccaggtcgcgcaggaccacgtgggcattggtgccgctcatgccgaacgcgctcaccgcgccatgccgcgcgccgtcggccttggccggccatggacgcggcacggtgttgacgaaaaaggcactcgcctgccagtcgacgaagtcgttgtgggtctcgaaattcaggctcggcgggatggtttcatggcgcagcgccgacgccaggcacagggtgctgaccaggcccgaggcggccaggctgtggccgaagttggtcttggtggacgtcagtgcgcaatgggcgccgtcctggggctggccgaagacctgcgccagggcgttgacctccaccgcatcgcccagggcggtgccggtgccgtgggtgatcacgtaatcgatctgccgcggcaccaggttgcaggcctcgtaggccgaggccagcaggcgggcctgcgcggcgccgttgggcgcggtgatgccgttggtcttgccgtcatagttgatcttgctggcggcgatcaccgagacgatcggatcgccgtcagccagggccgccgacagcggcttgaccaccagggccaccaccgcctcgccggggaccatgccgttggcgcgctggtcgaaggtgtggcagcgaccgtccggcgacagcatgccggcctggtccatgcgggtgaacgactgccgggtgagcatcaggttggcgctgctgaccagggccatctcgcattcccccagacgcaggctctggcaagcctggtgcaaggccaccagccccgaggagcaggcggtgttgagggtcatcaccgggccgtcgaggtcgaggaaatacgccaggtgcgaggcggcgatggcgctgtggttggcggtgatcgaaccggcgccgcccagctggaagtactcgccctcctccaggccgacaaacatcccgacccgacggccggccagctggcgcgggccgatgccggcatcttccagggcgcgccaggactcttcgagcaagagccgctggcgcggatccatctcttcggctgcccgcggggaaatgccgaagaacagcgggtcgaactcgtcgaccccgcgcaacgaaccgcagctgtagcccttgggggcttgcgccgcgctcaccgcgctgcggccgtccagcagcaactgccacatttcgtccaccgaatcgcattgcgggaaacggccgctggcgccgatgatcgcgatggactcggccagcaacgcgccgccgttgcccggggcctgggcaggcgccgggacaatggcccgttgctcgctcgagggttgcgccgcctgagccggggcggtcttgggcgtggccgtagccgcggccggcgcccggtaacgctcggtcaacgccgctgcgtgctgttgcgccaggtgcacggccagccgcgccagggtcggatgggagaaaaacagcgccgggctgaccgcgaagccgaaccgttgctgcatcgacctggccaggcgcgccaggttgatcgaatcgaaaccgaagctgctcagggtagcgtcgccgaccagttccgcggccggaatctgtgccacgtcgctgcacaggccttgcagctccgccagcaactgggcgggcagatccaccgacgcggcgggcggcagcaatccgggcgcgggcaccgccgatggctgcgcctggggatcgaggtcgaacaacgacgccaaccggtccgcatcgccgtaggccacggccacctgctccaggccgctgcgcaggatcgcttcgaaggccggcaggccctgttgcgcggtgagcagggcctggccgctgcgttgcaggtacgacgccaggtcgcggcccgctgcggagtcggcggcggcccgcaccggacccatgccgccctcttgccacagcggccagttgatggcgacggtctgcccgtgtcgctcgccgcgggcgacctgccggttgcgatagctggcgtgggccatcaggaagcgattgcccatggcgtagctggctgcgcccatgtcgccgagcaaggcggcggtcgaggagaaataacaggcatggaccagcgggtcgccggcggtcagggcatcgagcaattcggtgcccgccaccttgggcgccagcaccgtctggaacccctgcgccggagcctgcaacagccccggcccctcttcgacaccggcggcgtggataaacgcctgcagcgagccgaaggcagcgcgggcctggatcaacgcctgctccatcgaggcgaagtcggtcacatcggcctggaagtaacgcaccttggcgcccgtggcggccagggcctgcagctgttgctccagggcctgcgtcggcgccgcacgccccaccagcgccagacgcagggctgcgccatgggtacgcgccaggtaatcggcgaacagcagccccaggcgaccgctgccgccggtgatcagccaggtgccggcccgggccgacggcaagtccgcaggcgtcgcccctgcgccggactcgagcgccaggcgttgcgccgccagccgatagcgctgcgacccgatatagaggctgctgccacctgcgccgccgcgccattgcgccagcagcggctcgaaacaggcgctggcctgctccgctccggtcagggcgaagtcgcaggccgcggtgctttccagcaacagggtctgccagacggtctgcgccaggatgcgcggcatggaacgctccagtccgatccaggattccagctggcagcgctccagtccgtcgcggcacagaccggccagcaatacccgctgcaggttctgctgctgacgggccagcgcctggatcaggttcaccagcggcaccggctgttgcgcgagctccggcgcttccagcggccacaggtacagcaggccgtcgatggcgccgtgctgctggacgatagtccccagcacggcgctgacctcatgggcccgttgcgggtcgagcgcgaagctgtcggcgctgccatggccctggcgcgagaggaacaccaggcgagtgccgggcagctgcgttgccgcctgccggcgcaattgcgcctgctgggccggatcggacaggcagcacagcaccagccgcggttgctccacggctgcgctggcgacctcggcgggcgccgcttgccagcgctcggcgaaggtcagcacggcatgacgggaggacggctcgggcgtcggcggcacaggctgttcgtcgatggcccaatggcggatccgcgcaaacggatagctcggcagcgccacccggcgcacgccggcaggacgcggcagcgcgcgccagtccagggcgctgtcgcgatgccgggtccacaagcgcgccagggtgtgcaggtcgcgggccgccagggcctgctcccagtgctggccgggcgcctcggcgtcgctggcgtcggggctgctccagtagaccgcagcggcggccgcgggctcgtcgctcaatgggtccaggcgctgcgccagttccgccacgctgcccaccaccaacgccaggcgctcggccagcgggtcgcggcccacttgcagggtgtaggccaggttggctagcgagatgtccgggtacttctcaatatgccgggccaggcgccgggcgctttccagcaagcgctcgcgggtcctggccgacagcaccaccagttgctcgccgtccgccgccagcgcgacgttcggcgccacatactcttccagcaccacatgggcattggccccggagaagctcaggctgctgaccccggcgcgccgggggatcggctggccctgcgggtcgctcaggcgcgtccacggctggcgctggtcgaggatgtagaacgggctgccggccagcttgatgtaggggttctgccgctggaaatgcaggttgcccggcaaggtgccatgctgcatcgacaggatgatcttgaacagcccggccatgccggcggcggcttccaggtggccgatatgggtcttgaccgcgcccaggccgcagcgcccttcgggaatgctcacgccgtagttgcgggacaaggtggcgaaggcgtctttcaggctgttgatctcgatcgggtcgcccaggggcgtgccggtgccgtgggtctcgatgtaggtgatggtcgaggggtcgaccccggcccgggtgtaggcgtccaccaacagcatcgattgcgccagcggattcggcgcagtcagggacgacgcccgcccgccatggttctcggccgtggcgcggatcaccccgtgaatcacgtcgccgtcggcgatggcctggtgcagcggcttgagcagcaccgcgccggccccttcgccgcgcacatagccgttggccttgtcgctgaaggtcatgcagcgaccgtcctcgctcagcatcccggcgtcgctgaacgacaaggtgaggaacgggctgaggatcaggttgacgccgccggcgatcgccatttcgcagccgttgcggatggactccaccgcccggtgcagggcgatcagcgaactggagcaggcggtgtccaccggctggctcgggccatggatgcccaacaggtaggagatgcggttggccagcaccgaatgggacagcccggtggaggaataggcgctgaccggttgcccggaggccaccagcaggttgaggtagtcggtggcgccgacgccgatgaacaccgaggtccggctgccggcgaaattggcgctggcatagccggcgttgccgatggcgctgaacaccgtctcgaggatcagccgctgggacgggtccatcagcttcgcttcatggggcgagatgttgaaatacaggctgtcgaacttgtcaacgtcctcgatgaacccgccccacttggcgcgggtcttgccttcggccgggtcgccgtagagcgcctcccagctccagcgctgcggcgggaccgtggtgatcgcatcgtcgccggcgtccaggcgttcccagaagcgctccaggtccggcgagcccggcagcaccccggccatgccgatgatcgcgatcggcatggcaccgtggtcggcctgtggcgcggcgactggggttacgggcacgggcgccacagccggctcgggctgcgccactggcaccggcgccgcgacgatttgcgggtactgggccgagatgtatcccgccaccgcggtcagggtcttgtgctcgaagaacagcgccggggtgatgtcgatggcgtagcggccgttgagtttgttggccaattcgacataggtgatggagtcgaaaccgtagctgcccagctcggcgtcggggttgaacgccgtcgcggtcttgtgcagcacctgggccgccagttcctcgagggtggccatcaggtcggggccggcggcagcggcaggcggcgcgtcaacaggcggcgcttcggccaccggtgcggcgggtgccgccagggcatgctcgttcgccaggaactgcgccacggcgtccagggtcttgtgctcgaaaaacagcgccggggtaatgtccagggcgtagtcgcggttgatccggttggccagctcgacataggtgatggagtcgaagccgtagtcgctcagggccacctggggccgcaggctgccggcgtcgcgccgcagaatatcggcggccagccggcccagcgccagggtcaggcccgcgttatcggccgcggcgcgcgccggctgggttgcagccggtgccgcagccggtgccgactgggcaacggccatgccgagggttttctcgatcttcgcccggtcccccaccgccacgcagatcgaggtggggctcgccggcgacaggccgagcaacacttccagccccagctccagcgtcagcggctgcacgcccatcacattgcgcatcagggtttcggtctgttcgctgatccgcatcccgccgtcgcgccagtacggccagttgaccgccagggacttgccctggcgctgcccggcccgcacctgctcgtcgcgccactggacaaaatggtcgaggtattcgttggcataggcgtaaaccgactggccgacggtcccggccagggacgagatggaggaaaacaccaggaacaggtccagggcgtccccgcgggtcgcctcgtccagattgcggacacccgcgaccttgggctcgatcaccggccccagggcatggggatcctgcttgacgatcaggctgtcgcgaatcgccccggcggcatgcaggacgccattgaggacaccgaactcggccttgatcgccgcgtacaatgcggcgacgtccgcctggcgaccgacatcggcctgcagataacgggtcgtccccggcaggccggcctcttcggcacgggccagggctggcgccacgctgtgcgccgcggaacggccgcagagcaccacccgcgcggcgaagcgctggcgcaggtggcgggcgatctgcaagcccagggccccggcgccgccgctgatcaggtagacgccgccctggcggaacaggccctggggcgcgagcgccgccgagcgctccaggccctccagtcgctgcacctggcgcacctgtcgctggtagcgaaccagcacctggccggcttctggcccatgccgcaactcttgcgcgacccggcgcgcggcatcggcttcggagccgtcggccacctcgaggacactggccgacaacccgggatgctcatggcgcaggacccgggcaaagccggccagggcgcgatggctggcatggcccgaacgactcacgaacagcagccggccctgggcacgctggcgcgccaccagcatcggcagcagttgatacagcagctgcaacagcgcctcctcttgcagcccatcttccagcaggaacagcaggttcaagtcgccgctggccggcagcgcgtccagcagccgctgccagtgcccggcgttgcgcgggtcgatgcccagggtcttgccgccgtcgctgacctgcagcgaaccgtcgctggcgggggttggcgacacacgccggggctggaagcccagggcctgttccagggcctgccctgccccgcgggtcgccgtgaacagtacggtgtgtgcggccgatggctgggccgcctggctgttgaggtcttgcgtctgccagtggggagcaaacagctgcaaatcgtcctgcttgcgcaacgagtaaggccggtaggacaggctgcgcatagccgccagtacttgtccgtcgtcgctcagcaggtcgatgtcgaaacgcttttcggcaaactgcgccgaaccgtggttgccggccacccgggcataggcgtggcaggtcgccgtgagcggtgcgtagacggtgatctcgccgagggcataagggatgtacagggtgtggtcctggctgggatcgccgagcagccccagcaggctctgcaacgcgccgtccatcaacgacggatgcagggtgtaggccgccaggtcatggcgcagggcctggggcaggaccagccgagccagggattcggaggcgttgaagtgcagggtctccaaggtacgcaggcccggcccgtagaccaggtcgttgcggtcgaagatccggtagcagtccggcgccggccagacctcgctacagcgggccttgatcgccgccagatccatgcgcgggaccgcgtccggggccggcacccggcgcacccggccctgggaatacagctgcccggcgccgtcgctgacccggtaggccgtgccgcgctcggtctgttccaggtcgacctgcacctgccggggctggtcggtgacgatcaccggcttgatccaggccacgttctgcacttgctgcacctgcccctctggcgtgtcttcgccggccaggcgctgggcggcaatggccatttccaggtgggagacgccgagcaaggtcggtgccccggacaccagatggtccttgaggtacacctcgctcccgtcgaagcgatggctgaagctgggctgcgcggccccgctcaaccggcgggacaggatggggtgcaaggccggcccgtcgcccgaggcgccgggcgtgccggcggcccagtaaggggtcgcggcaaaggcataggtgggcagcggcacccgccgcagaccggcctggggcgagaagcctgtccagtccacggccgcgccggccgcccatagacgggccaggtcgcgcgccgcgggttgccccagcgcggccagctcggcctgggccgcctggcgttcctgctcactgggttcgtcgccgacgaacagctgctggcgatcgtcccccttggccaggaaggcgcgcaatccctgggccagggattccagggagtcgcacaccagggccagcctggcggccatcgggtcgcgcccgctttgcagggtgtgcagcacatcgcgaaaggccggcagcggcgtgctgccgtccagccagtgcagcaggcgcccggccatcactgccaggcgttccggggtgcgggccgagagcactgccaccccggcgccgggagccgcggaatggggagccggcgacgccgcggccgccacgtattcttccagcacgatatgggcgttggtaccgctgaaccccagggagctgacgcaggcccgccgcggctggtcggcctgggcggcccagggctggaggcggtcgagggtgaagaacgggctgtcggcaaaatcgatgtgccggttgggttgttccaggtgcagggacggcggcagcgtccggtgccgcaggcacagcacggccttgatcaggctggtgatccccgccgccacctgggcgtggccgatgttggtcttgaccgagccgatggcgcagaactgcttgtgctcggtccgctggcgaaaggcggcggtcagggcttcgaactcgatggggtcgcccaggcgcgtgccggtgccatgggcctcgacatagccgatgctgcgcgggtcgatcccggcgcgggcatagacgtcgctgagcaactgggtctgggcataggcactgggcacggtaatgcccggggtcttgccgtcctggttgatgcccgaggcgcgaatcaccgcgtggacggtgtcgccgtcacgttcggcggcggccagcggcttgagcaccaccaccccgaccgcttcggaaatcacgatgccattggcccgctcgtcgaacgtcttgcacaagccgtccggcgacagcatgcccagctgcgaggccaggacaaacagttccggggtgttgtagatcatcaccccgccggccagggcgacgtcgcacgtgccgctgagcaggctttcgcaagccatgtgcaccgacaccagggatgacgaacaggcggtgtccacagccaccgccgggcccttcaggttgaggaaatacgacagccgcgcagcaaggatcgacgaggtgttgccggtcaggctgtaggcgtcggccggcgtccgctgctggcgcaggtgcgtcaggtaatcgccggtgacgcagccgacgaagaccccgcacttgctgttggaccaactgcccggggcatagccggcgtcctcgatggcgccccaggcctcctggaagaacaggcgctgctgggggtccatcaacagcgcttcgcgggggctgatgttaaagaagtcggcgtcgaagcccttgatgtcgtccaccagcccggcccacttgctgtagctcttgtcgcgggcattgcggtccgggtcgaagtagtcgcgactgtcccagcgactggcgggaatctcggccacgctgtcgcgcccggccttgaggttgtcccagaaggcggccgtgctgtcggcaccgggaaaacgcccggacatgccgatgatggcgatgtccatcacgcccgcgggcggctccttggcgggctggccggcgccgccggccaccaggcgcagcaggtagcgggcctggaccagggagatatggccatccttgaccagattgaggatatcggtggtggtaatgcacacagtcattggaaatcacccattaaacgattggcctggtcgacgctgagtcgaccgctctgcaattgcgcgaggatgtcgagcaaggcctggtccgggtcctcgccaggacccgcggccggctgcgatggcatgacgggggttgccggggcgttgcccctggcccgctgttcgagcgcgccggcgaaaccggccagggtcggatgctcgaacagcaggctgaccggcagcgtgatgcccaggtcctgctggacctggtagatcaggcgggtcgcggtgaacgaggtgcctccggcgttgaagaaatggctgtcgccactcgcctggggcaggccgaggatggccgcccagatgccggccacctgctcgccccggcccggcgccgcggccgcctgcgaaggcacggcctccagagcctgcggcgcgggcagcgccttgcggtcgatcttgttgttgggggtcagcggcagcgcgtccaggcgtacgtacaacgacggcaccatgtacgccggcaagtcccgcgccacgagctggcgcagctcggccttgagcgcctcgtcgagcaccgcgggcgcggcgaggaccaggtaggcggtcaataccccttccgcgtcgccgcccgtgccgcgctggcgcagggtcaccacgccgtcgcgcacctggggatggctgcgcaggacgttctcgatctcgccggcttcgatgcgaaaaccgcggaccttcaactggccgtcctcgcggcccaggaactccagctggccctggagcgtgaggcgcgcctggtcgccggtgcggtacacccggcccgtggcggtctggatgaacttctcggcgttcagctccgggcggttgaggtagccgctggcgaccccttcgccgccgatgcacagctcgccggccacccccggcggcacttgcgccagggccgcgtcgagaatgtgcaggctggtgttctggatcggcttgccgatcggcacgatggccgactcgccttggccgtcgacccgttctacacaggaccagatggtggtttccgtagggccgtagaggttccacagctcccggctgcgcgccagcagttcgcgcgccaggctgcgcggcagcggttcgccgccgcacaggatgcgcaagtccggcttgccggcccagccgctgctcaccagcatttgccaggtggtcggggtggcctgcatcagcgtgatccgctgctcgtcaagcaggcgctgcaagtgcaggccgtccatggccgcctcgcgggaggccaggaccacacaggcaccgttgaccaggggcaggtacagctcgagggcggcaatgtcgaaggaaacggtggtcaccgccagcaagagatcctgcgccgaaagccccggttcgcggcccatggactggaggaagttgctcaacgcctgatgggagatctgtacgcccttcggtcttccggtcgagccggaggtgtagatcacataggcactgtcctgcatgcgcgactggcagggcacattgtctggcgaacaggcctcgatttcgctgctgcgcgccgccaggtccagcagcaccgtgccgtccaggcccagcccctggggcagcccggccaggctgtcgaccagcatgaaggccggccgggcgtcttcgagcatgtgttgcagacgctgggcagggaaacccgggtccatcgggatgtagtaagcgccggccttgaacaccgccagcaacgccgcgaccagatcgcccgagcgctgcatgcacagggccacgccctgccccggcgccaggccggcggctcgcaggtggtgggccaggcggttggcccgctggttcaaggcctcgtagctccaactgcgccgggggtcgaccagggcggtctgcgcggcctgttgcagcacttgccgctcgaacagctgggccgtggtcaagggcgccaccggcgcctggataccttgcaggcaggcggccgagagggccaggtcctgctgggcgaccaccggcagcgaccagaccggggtccagggctggctgacgcagtgccgcaacagggtcaggaaaccctctttcatgcgtgccatggtcggcgcggcgaacaggtcggcattgaacttcagggcgccggccagttgcccgtcgatgtccatcatctccaggccgatctcgaactggccctcttgctgggcaaaaggcacggactccaggtgcagcccctggtgtcggatcggcaccccttcgcgaggcgacaggatgcggatcaattcgctgctctggtgcggtttctggtagacgaactcggcctggaacaacggcgtacgcccggcttcgcggctggggttgaggtcctgcaccagcttggcgaacggcaggcgctggttttccagggcctccagcaccacctgtttctgctgttgcagcaactcgctgaaggatgggttggcccgcaggtcggcggccagcaccaccgagttgacgaagtagcccaccagcgggttgaagcgctggtcgaggcgtcccgagaccggcgagccgatccgcacctggcggtccgaggaatagcggccgagcaggcattggtaggccgccagcagcacggtgaagaccgtgacgccttcgcgttgcgccagggccttgaggccttcgctcaactcggtgccgcactcgatcgccactgaagcgccattgaaggtctgggccctgggccgcgggaagtccagcggcaggttcaggcgcacctcggggtcggccagctggcgcttccagaagtcgcgctggcgctggccggcggcgctgtccaggaaaacctcttcctcgcgcacgaaatcggcaaagctgctggtcaagggcgccagcaccggttgttcgccacggcacagggccgcgtagccgctgagcaactcgtcgagcaggagccattggctccaggcgtccgacaccaggtgatggacggtccacagcagcagggtgtcgcactcgccgcagatgaacaggcgcagccggctcagcgcgccgtgctggaggtcgaacggctggcgatgggcggcccgcagcgcttcctggacctgttcgcgcgactggccgaccaggttgtgcacgccgatgtcgggaagcgccgttggcggaatttcctgcaccggctgcccctggcgctcgcaaaaccgtgcgcgcagcgccggatggcgctgcaccagcaggctgtagctgcgctccagggcggagcggtccaggggcgagcgcaggcgcaaggtcatggcgatgtgataggccgcgctgtcctcgttgagcttatggataaaccacagcgactgctggccgtgggtcatgggccagacctcggcctcggcggccggcgcggggctatcgatccagtccgccctaggcacgggggccaggtaagggtcgggatagctcaccgcgactgccggcgcgggccgggcctcgacgggcactggcgctggtgcgagagcgggcgcgggtgccgcgaccggcgtcgttgcgggttgcaactgcgcggcagcgctcgtctcgagcagatgctcttcgcagatatgcgcggtgaaggccctgaggctggtgtggcgcagcagcgcggccggctgcacgctgatgtcgaaggcgtcgttgatcttgttgatcagcatcatcgcgccaatggagtccaggccgtacctcatcaggtcctggtccgggtcgatatcggcgggttccagcttgagcaggtccgccagttcgctgagggtgcgttcccccaccgccgacgcgccctgccctgtcgaaccgccggccgtcgagctgccggccgtcggacgtgccgcgggggccgcgctgcgcggcgccgtgggaaattcgttccaggccgcctggatggcgctggcctgtccctggacgatcacccgctgagtcgccccttcagcggccaggcaacgcttaagggcagcaagaccggcttcggtatccagggccaccaggccgcggctgcgctccaggaacagcgtgctctgctcgtcgagctgcatgccgccgtcgcgccacagggtccagttgatcgccaggctacggccctggcgcagcccttgctgcacccggcgctgccgctgggcgacaaagccgtcgaggaagcggttggcataggcgtagtcggtctggccggcaaagcccatgaccgcggaaatcgacgaatagaccacgaacaggtccagggcttcgtgctccagggcctggtccagcagggccgcgccaagcgccttggggttgacgatgcgggcgatccgctcggcgttcttgctcgccagcgcggcgttgtccatgctcccggcgcaatgaaacacgccgtggatgcgctcgacccgctgcctgaccgtggcgaccagctcgagggtgccttgcgagtcggtgatatcggcggccaggtactccacccgcccgccctgctcgttctggttcagcgccgcgagacgctgctgcgtcgccgccggcaactgcgccgccggcgtccggccggtgaggatgacccgggcccgatagtcctcgaccagcagccgggccaggatcagccccagcccgccggccccgccgctgatcaggtaggccccgccctcgcgcaagaccggcgccgccgcgggcgcctcggtatcgagggcggcgctcagcagcaggcggcggtcctcctcaaggcgcacttccacgccctggccaggtgactggcggacgccgatttcaccctccagcagttcggccaggcgtggcgccccatggccaggcacgccgacggagcgggcgacccacagcggctgctcggcggccaggctgcgcatgaagccgcccacggccaccccggccggcacgtcatggggatagaaatgcagcagcgtcgtgcccttgccggcatcggtgcggatcaactgctggctgataaacgccagcgcatgcagattgagtatcagggcctggggcaatgccaccggcgcgcccagggcccaggcatggacaacggtcatcccggggctggcgcaggcgtcccacagcttcgcgtaatcgtccgggttgccgggggcgatctcatagtgccggggcgcgacgcagcgaaaggcggcagcgggatacaccagggtgtcctgggggcgcgccagccgggctgccatctgcgcgtcggcgaccaacagcaggcgcggcgcctgcaactgcgccgcgtcgacgctcggcgcaggcgcggcgggcagccagtccatgcggtactggtggctgggcagcgcagccggctgcgccttgatcgggcgcagcgtcaggttgtcgatgtgcaccagcagctcgccgtcctcgccgaggatatgcaccgagcactgggcgctttcggcgtcgatttcccgcagttgcgcgacgctgtagaaatgctcgggcagggccttgaagacgctgatctgttccagggcgtaggggatgtaggtgctgctggggtcttcctgctcgcaaaagcggatgcacggctggaacgcgctgtcgagcagcgccgggttgaggacgaagccatcgagcaacgcgtaatgctcgccaaggcctgccggtaccggctgttcgccccggctgccgcccgcctggcgctggatctcggcgatcaggtactggccgctgcgcgagagggtcttgatcccgcgaaaggtcggtccgtaggcaaaaccctgggcagcgaaacgcgcgtagcacccagcccgctcgtccagcgcccgggcctcggccagcaacccggcgaggtccggcagcgccggcacctcggcaagcgtggtgtcgatgacgatctcgccctgtgcgcacagctgctggcgggcattggacaggtcatggatctcgaagcgggtcttgccgtttttctgcttcaggcgcagttccaggatggccggttcgcggtccaccaggaaaggctgcagccagacgatattgcgcagccgggaaaccgtctggcccgcggccaggtagccggcggtgcaggccatttccaggtaggccacccccggcagcgttttgcgcccggcaatcacatggtcggcaaaatagaattcgtcgcagcgaaacaccgagcggaacgccagttgctcgaaggtcgacacgttgtgctgcaccagttgcgaaagccctgcggccgccgccggggcgccaggcgcctggaacaccggcatctggcaggggcgctgcgcaaacggataggtcggcaggctcacccgccgcggctgcggttcgccgcgcaggcgccacagcggctgccagtcgaaaccgcgccgcacccacaaccgggccagcgccgcccacttgccctcctgcgcccagcgcaaggccatcgccgggatttcttcggcatcgagcaaggcgtcctggtcagcagcgggtttgccgaggaacagcctggcctcgccgtcatcgccggcggtccccgccaggtagccggccaaggcctcttgcagcgcatccagggaatcgaccaccagggccaggcgcacgtccatggccaggcgcccgacctgcagggtataggccaggtccgcaagacgcagcggcgtgcccccggcgtgcaagaagtcctgcaacgcgctggcataggcccgcaggcgctcttcgttccgggcgctgagcacgatgacttgctcggcgacctgctcggccggcgcgcgggcgggctcgggcacgggctgcgggtactcctccagcaccgcgtaggcattggtgccgctgaagccgaacgagctgaccccggcccgccgccgggtgccggcgggcacgttccattcgcggttgtcggtgttgatgtagaacggcgactgttcgagccggatatgttcgttgagggtctggaactgcgccgagggcggcaggcggcgatggcggatcgccaacagcgccttgaagaagccggccacccccgccgccgccagcatgtgtcccatgttgcttttcaccgagcccagggcgcagaacgcggtatcccgggtgaacggctggaaggcgttgaccagcgcctccacttcgatcgggtcccccaggggggtgcccgaaccatgggcttccatcagcccgaggctgcgcgggtcgatcgcgaaccgctcgaacaccgcttgctgcaactcggcctgggaggtctggctgggcgccgtgatgccgttggtcttgccgtcctgattgacgccccagccgatcagggtgccgtagatcgggtcgttgtcgcgctgggcatccgccaggcgcttgagggccaccaccccgaccccttcggccgggacaaagccgttggcgcgctgatcgaagctgtagcaacggccgtcggcggacagcatgttggcctggctggccatgatatggatcgacgggtcgctgaggatcgacacgccgccggccagggccaggtcgctgttgcccatgagcaggctgtcgcaggcctgggcgatggccaccagggaggcggaacaggcggtgtcgatggtcaggcacgggccgcgcagatccagcaggtaggcgatgcgcgcggccaggatcgaggtgctgccgcccaggaaaccggcggcgctcagggcgttgccgttctggctctgaccgtagttgccgcagccgacgaagaccccgcactggctgccggccaattgctgcggatgcaggccggcgtcttccaggcagctccacgcctcttgcaggaacaggcgctgctgggggtccatgtcgtcggcatcggccggggaaatattgaagaacagcgggtcgaagcgatcgatatcgtcgacggcgccgatgaagtcggaatagcttttgcccgcctggcgcgtcggactgtaggcctggtccatgcgccagtagtcgcgggagacgcggccgatgcagtcgcggccttcggccacggcctcccagaacgcctgcacgttgcgcgcctggggaaagcgccccgacaggccgatgatggcgatggcgccggcgtcggccggcgcaggcttggcgacaggcgccgaaggtgtcgccaggggagcaacggtgcccggttgtccgtggctgcgcggttgcccgcgaaacgaccccagcttgcgcggcgccaggggcgcgacgggcgcctgttcccgggccgtcggcagcgctgcggggactggcgccgtgggcgccacggcgggcgccggacgccggccgaacatcgtccgggccgggcgcggggcgccgccctcggcaccttcggcggcgagctcctggtgcaccagctcggccatccgggccagggtcgggtagttatagacccgcaccgccgggatgctcagcccataggtctggttgacctgggcatccacatcacgccgatacgcgaggtcaggcccaattcgaaaaaggtccggctttcgctgatttcctcggcggcaacgcccagcgcgtcggccaacaggcgacgaatggttttcttcaccgattgcaagtctttgacagacatctgagttccatccagaaagttaggtacgcaggcgcgcggggttcaggcgtggggtttgatcgcgatcacgctggcatgctcgaggccgccgctggcggcctggccgccatagtcgatagccaggccttcatagccggcctcctccaccagcaacccggcgaaccggcattcgcgggccaggatctcggggtcgaccaggttgatcagcggcgtgccgttgagcgcatcgctggcgtggctgccgctgtcgatggcgttggcggcactggcctgggcccggctgcggaagtagccggcaatatcggcgatatagcccggccactcctcgccctgggcgttcaggcgctcgtactcctcgacccgggccgcccagtgcgggaagtacgggctgtcgcagatcaggaacaagcgaccgcccggcgccagccagcgggccatcttgcggatcgattcgcgaaaggccgggggcggcaggaaatgcaggatccgggcggcatgaatggcctggaagcgacccggcgcgaaatccatatcgggcaaggcgcccgccagcgtgtccaggcggccgcgcagtcggggcgccacgctgccggcgagaatctccaggtgctgcgcttcgatatccaccgccagtacccgcgcgccctgctccagcgccgcgatcgtcgccacgccgtaggcgcagcccatgtccatcacttctcccgtcgaggcggcggcagactcgacgaagcactgcgaacaggccggcaggacggtggtcatggctccggtgccgttgagcgtcgggatcatgcccttgacctgttcgggcatgctcgccggcgccggcgcctggttcgcgccccgggcatcggcatggctgcacaccacgtcccgcaactgcatcagcacctcgcccgcggcgtcgcacatatcgacgtccaggcgagaaaccgtggacggcatctccacctgggcaaagtcgttgtcggagggccgtagccacagccaggcggcgttgtccaaggcgccacgcacaagcacttcatccaccgacagcagcgtgagggcattgacctcgcagccctgggcccgggccagcaacgcagtcagttgcaccagcggcgtcgcgggctgcgccaccgggtgccagcccgcttcgcccgagcgcgccgccacgttcagcgcggccatgggctggcgcggctggaacagcgcctggccatggatatgcaacgccgcgtcgccctcgcccagggaaccgatgcggtaatcgatcagatcgttttcaccgggggccagggtcagctcgacagcgaccggcgaccgattcacccacagcggacggggaaagatgatgtcctgcaacgacaggccaagcggctcgtcgggcgccacttcggccgcctggcgcgtggcctggatcagcatgtccagatgcgccaggtcgacgaaacggcgcgaattttcggcgtccccgacaaaccacggctcctgcccggtgaagtccgagcggtatttctgcgccataaaggtggaaacgttgcgctgcaggatcggcgagagcaacgccccttcctgcgttgccgccgggttggcggccggcgcctggggaatccacaacgcatgccgggcaaagggataggtgggcaactgcactgtcttcaggggcggctggccggcgtacaggcgctgccagtccaccgccaccccggccacccagatacgtcccagggcgcgctggttatgctcgtcgagccactgctgcacgaccgcgtgcatctccgggttggcaaagagctgacgcacgtccttgccggtttccaggtcgcgttcgaggaaggcgcccggctcttcctggccggccgacagacgctccagacgctcgaccaataccgccggcgagtcggcaaatatcaccgcgcgatgctcgaagtgttcccggccggtctgcagggtgcgggcaatgcctggcaggctgaggtgctcggcctcgggcgattgcagatgggccagcaaacgtttgcctgtctgcgcgagctggtccgcggtgcgggccgacaacaggatcgcctgttcgccagtagcctgtggcggcacggcgggcgactcggggtcgaggtattcgccgagcaccatatggccggtgacgccgccaaaaccgaagttgtggatcccgatatgccgcgcccgacgctggccgtcgagcgtcctgggcgcccaggcgccggtctggcgcaccggttcgcaggcgaagtcgccctgcgcggcatcccagttgaagtgctgcaggttggcgatcttgatcagggtgtcgtgcttgaacgccaacaggctcttgatcagcgagatcaccccggaggccccggaaaaatgccccagctggcccttcagggtgcccaagcccggcttgctggcgcagcccttgaagaccttgtcgaacgcgttgagctccacctcgtcggccatcgggttggcggtgccctgggcttcgatgtagtcgatatcctgaggttgcaggccggcctgttcgagggcctcggctatggtttcgcaatggatctcggcattcggcgcggtgaggtagaggctcttgccgccatggcgcaccgacaggcccttgatgaccccgagaatcgtgtcctggtcgcgctcggccagcgacagccgcttgagcatgaccacccccaggccgtcgctgaagaagtgcccgttggcttgcgtgtcgaagggccgaacgatgccgtcgccggtaaacaggcccagcttgcggttgtagatgttcacttccgggctcagcaccaggttgacgccgccggcgatggccgcctgggcctgcccggtgcgcagcgccgtgatggccctgtcgatggcgacgaaggagctggtgcaggcggcatcgaccgtcgccaccgggcccttccagtcgaaatagtgggcaatacgattgaccagcatggcgtgggcgttgccggtgttcaggtgaccgtcgatctccacctggctggcgcggatcaggtcggcgtagtccttgcgctcgatgcccaggaacacgccgattttctgctggcgcaattgatcgcgccgataaccggcggcttccagggtttcccacacggcttgcagcatcagccggtgctgggggtcgatcagcgccgcttcgcgcggggagatgttgaagtgcagcgggtcgaaaccgcgcacatcgtcgataaaggcgccgtggtaacagtcggtcttgtcccggctgtcgaggtcgccaaagatcgcccgccagtcccagcggtcggccggcacctcggaaatgaacggctcgtcagccaccaggcggcgccagaagtcggccaggctgtcggacttgggcaggcgcgcggccatgccgatgatcgcgatgtcctcggtcaacgccgcgcgctcgccatgcttgtcggcacccgccgccgtgtgcggccgaggcccctgcccgctcgccccacgaacgctccgggcaatcggctggaccgtggccccggccaggtgggtgtgttcatgaaagtaacgctgcaaccggtcggcgaccacctgttccaggtgcccgggcgccgctgccggggctggaccggggccggctttgagcgcgatgtgacgcgccagggccgacagcgaggggtgttccatgaaggtcgacggcgccagtttcaagccgggaaaatgcgcggcgatgcgctgggaaaactccgtcagcgaaatggagttgaaaccatagtcggccaggctgcggtcgggttcgatatcgctgcgctcgaaatggatggtggcggccagaaagccggtcagctcggccagcacctgttgctcggggagcgccccctgcgtcggcgcgggttgctgcaccgattcgtgcagttgcctgatcatctccagcgcctgctcgtcggaaatgctctggctggaaaccttgtcgataaaagcgttcaggtatggcatcacgaggcccttgagattttcttgagttccgacaggaaattgtctgcgttgatttctttgctctggatcttgcgaatcaggcccaggtacacccggtcatgctcggcgaccacccggtccagggactcggtagcctggtcgatggccagcgcgcggtcgctgaggggcgtcaggaactggctgtcccaatcgagccgcaacggattgtcgagctgggccagggcggcctgatgttcctctgcggtgatctgctcctgggccgccaggctcgccacgacctcgcggcccagaccggccagcaggcgcgtcttgaccttgctgatctgggtgtcgccggtctcgtcctggataaaggcccgcgtgcggctcgcggccacgatggccgcggccccggcgctggcatggggcccccgcaggcggtactgggcgggaaagcacggcgtgttgagcaggctccagaaggccttgaactcgcgaaccgggtccggcaccaggccgagcttcatgccgatcaccacgctggccaggggccccatgatgatcttgtcggtgtcgactatttgccccagctcctcctggctgagccggtacttgccggagaccacctgggcataccagcgcgaggccatttccaggtacgggaaggtgccgatgaccccgatttcctggagcccgtactggttgaacaacagcggatcgtcccggtagaacaggcccatggccaggtcccggaccggctccaggccttgcacgtagtcatacaacgccccggtgcggtagccggtgcacagcaccaccacatcgatgtcgtcgaggccccgctcatgcccgacgtggaagcaccgggcgccggcaaatcgttccacctggccgaagatcgtctcgatcttcccggcgttgaccaggtccaccacctcgtcgttgatatgaatgaacgggtgctggcggaactcggtcaggctcggttgcaggccgctgcgctgcaaggcctcgctgaaggtcggcatcgccagttgcagacggtcgatattgcgttgcgcccgcaggacttccggcatcagcagattggccggggagacgaaatcgttgggcaggaaacccaccatccgcggcaggatgaacttgcgcgaacgcaggctccaatagaccttggcggcgaccttgctggcttcgccggcgatgtccatgccgctgacgccattgccgatcaccaggacgcgcttgcccgccagcgacgcgttgtcgaaatactgccccgaatgcagcacctcgccggtgaaggtgtccaggccgggaatccgcgcatgctggggaatctggtagcgcccgtgacacagcgccaccccgtcgaaggtctcccggcggcgtgttcctccggactcgatttccacctcccagccatcgccctcggccttgaccgaaaccacccgggaccggcagtggatgtggcgttcgaggtcaaagcgggcggcgtaggcatcgaggtagcgccgcacatcgtggacattgggaaaggtgtcgccgatgtcctcgggatagaagtcggaaaagaaactggtgtccttggagttctggaaccgcgtggtggagtaagtgccgacctgcttgtcccgcttgagattccagaccccgcccagggtgtcctgggcctcatacaccaccggctggtgcccctcttccagcagcgacttggccatcaccaggccgccggggccggcaccgatcacgcagatcctccgcgccccgggcgtggccgccggctcgtccttggccagggcgttgtaggtcttgagctggaacggatagccgggcaacgccagtttcttcgcgctgccaggcggatgcaggctgtgccaggccggcgccgcgcctgcgacccactgcgcggccagggcggccagttcgccgtccgccgcaaggtcccgaccgctggagaaaatgccgtccggccagaccgtatccggcgagcccgcggccagggcctgcaaggcgctggccagtcgttcgccggcctcggcgagggagccggcgacaaaggccagtcgcaccttgagcccttcgcgaccgacttgcagggtgtaggccaggtcccgcaaccgcaactgcggatgggcgcgcaggtgagccagctggtcttccaggacgctggccagttgcgccggagtccgggcggagaacaccagcaattgcgcgctgtcgtctgccgcgcgcgtatcgggcggcgggcaatattgctcgacgatcatatgggcgttgaccccgaagccataactgttgatggcggcgcgacgcggcgccgcggcatcggcccagggctggttctgcgcgctgatccggaacgcgctggcagaccacaagcgggcgacgtcctgcgtggtcacgccgggcacccctggcttgatgccttgctgcaaggcgaacaccaccttgatcagcgccgccatgccagaggccacttcgctgtggccgatgcagggtttcaagctgcccagggtgcagtcgcgggcagccggtgcggcgcgccgtgttcggcgaacaccgcttccagggcgctcacctcgacgctgtcgcccagcaatgagccggtggcgtgggtctcgatgtagcccagcgtttgcggcgccacccgggcatccgccagcgcgtcgagcatggcgcggcgcataccgtcctgattgggcgccgtgagcgaggaggaacgcccgccgtggttgacgctgctgcccttgatcaccgccgcgatccggtcgttgtcggcaagcgcctgggccagcggcttgagaatcaccaccgccgcgccttcggaacgcacgtagccgttggccccggcctggaaggaacgggtggtctggtcggggctcaacaggcccatggcgtcgtagctgtggaaatactccggggacagcaacaggttgaccccgcccaccaccgcctgctcgcactcgccctggcgcagggcgcggatcgcccggtgcagggctaccagggatgacgaacaggtggtctcgatgcattcgctgggcccgaagaggtccagggtgtgggacagccggttggcgaccatggacgccagctgcccggtggccaggtagcccttgttcgcttcgtcctgcgccgccgcgaccccgtagtcgttctgcgaggcggcgatgaacaccccggtgcgccgctggctgaacgcctgggcgccgataccggcgtcttccagggcccgccaggtgtaggtgagcatcagccgctgctgcgggtcgatcagttgcgcttccttgggcgccacctggaaaaacaccgggtcgaagtcgaacgcgtccgcgatgaacccgccccacagcggcctgtcggcccgggccagatgcgggcgcatcagggccgcgggggtcatgcaattgcgcccggccaggacattggcccagaaggtttccttgttcggcgcctgggcgaagctgcaggccatgccgacaatggcgatgtcctgctgcgcagcgtcgccctgcccggcgggcctgtcgctgcgtgcgggctcttgggcagtggccgtcggcgaggtttgcccaggggccaggaccagctgtgcgatggccgccgggctggcgtgccgggccaggtcgcccagcgtcagttgcgtatcgagccgctggttgagacgggcgagaaaggcattggccgcaatcgaattgccgccgatctcgacgaacaggctgtcaggctggatgtcttccacccccagcaacgcctgccattgctcgatgatgtagcgctcgacctcccccggccccgcggcattggcgtccgacgccacggaaatgggccgttgcgccagcagcttgcggtcgaccttgccgttgggcgtcaacggcaggcgctcgatgggcaacagaaagctcggcaccatgaagccgggcacgcgcgcgccgagccaggtcttcaggcgagcggccagggaggcgtccggcaggttcaggtcgcgcgggacgaagtagcccagcaattgcccggaaccggcttgctgccgagccacgaccaccgcttgcaggacctcgggatgactgtccagctgcgcttcgatatcgcccacttccacccggtagccacggattttcacctggttgtcgatccggcccaggtgcagcaacaggccgtcggcctgccagcaggccaggtcgcccgtgcggtacaacttgccggaggtttcgaaggggttgtcgatgaacttttcggccgtcaggtcggggcggttcaaatacccttcggccaggcccgccccggcgatgcacaactcccccggctcgccgatggtgcaatgactgccatcgtcgcgcagcaggtacagccgggtgttggcgatgggccggccaatggaaaccggctgcccgggctgaagcttttgcagggtcgaccagatggtggtttcggtcggcccgaacatgttccagacgctattgccggcctgctcgaaacagcccttcagggcatccggcaacggctcgccgccacagaggatgcgcaattgcgccgagggctgccaaccggcatggaacagcatcgtccaggtcgccggcgtcgcctgcatgagggtgggccggacctgggcgatcaggctcgtcagctggctggcatcgcccgcggtctcggtcggacagatatggcagcgaccgccgacgatcaatggcaggagcaactccagcccggaaatatcgaagcaatgggtggtcaccgccagcagggtgtcgtcggcgagcatgccgggctcttcggccatcgacaggagaaagttgctcaacgcccgatggctgatcatcacccccttgggttggcccgtgctgccggaggtgtagatgatataggccaggctgtcgggcgccgccgccgactccggcaaggggctctggcaagcggcaacgagcggccattggcggtccagggcaaggctgttgcagtgctcgcccaacagggtggcgagggtcggctcgagcgctgcctgggtcagcacccaatggctgtcactgtcctcgagcatgtagcgcaagcgctgctcggggtacgtggggtccagcggaatataggtggctccggcgcgggcgatggcgagcatcgccaccaccaggtcgagggagcggtgcatgaacagggcgacccgcgagccggcgcccaccccctgcccggctaggtacgccgccagctgagtgcttttgtccgccaactggcgatagctcaggctgtgtcgggcatccgccagggcgatcgcgtccggcgtggcccgcgacctggcgtcgaacagctgatgaaaacccgctgcgttgttgaagtcgcgcgcgttggcgctccacgctactggaacaggattgactgacatgggctactcccccgaacggccggtgatttcgttgagaaggatgttgatgttgctcaagtccttgccgaactgattgatcgaatggctgtacttgagaaggttggggcgggtatatttgatgaagttggccagcgagcccgtggcgctcagatcgacgaacaacgactgattgccgctgctcgaaaggtgcttgatcagcccatggaaatcgacgggctggcgaatgatgcgccacaggtagtcccgcgcattggccaggtcgccggcatgaatggcccgagcaaacgtcgatgagtaataagggatggtgggcgcactgaaggcgatgccttccaggatcgacaggatctgttcccggaccggctcgatatggctggagtgaaagggatactggacgggcagctcgatgcagatcacccccatgccgtccaggccgcgcttgatccgggccaggtccgcctgggcgccggcgacgcagaaattgtcggcgaagttgatcccggccagctccacctgacggtagagctcgggatgttgttcaacgtgctccacgggcgccaggacgctcagcatcccgcccttggggccatgctcggccagcacccgcgactgacgcagggtcaggcgcagcccgtcctgccaggacaggcagccgctgaccgtcaagccgatgtactcacccaggctgtagcccatgacggccttgggctcgacgccttcggcacgcagcatggcggtcaggctatagccgatggcgaacagcgcaggatgggtttgcaggatcgagtcgaacggctcatacactcggcgcgactcgtcatagatgaccttgaccagggaaaaccccgcctgcgcctccaccagcgcgttgcaggcatccatctggtggcggaaggccgggttgtgctggtacagctcgcgccccatctggaagtactgggtgccctgcccgccatacatgaaaatcgtgtcctgtatcagggaggcaagcggagccggcgccgcggcaggcgactggatgaccataggcgccttgagaatcttgtcggtcagcttggtcaggacatttccgggcccgagttcttcgatcggctggatgtcctgggccagcagccaggaaacactttcgtaccatttcaccggatgagtgatctggccgctgaggatgctggagtaatcgcgctgcggataagggcgagccgtcatgttcgagatgacgggggtcgccaggggttgcaacgagaatcctgccaggtagctggcgaactcgcgttcgacgtccttcatgtagcgcgagtgaaaggccgcgctgacgttcagcgggacataagtggcgccagcctgctcgaagatagcccgggtgcgttctgcggcaatatcgtagtgcaggccggaaagaatgatctgatcaggtgaattgatattggccaggtcaatgctgtccaaccccttgtcgcgcaggatcgtgcggactgtttcctcgctcaatcccagcacggcggccatgccccctttgggcgcctggctcatcaggcggccccggcgctggaccaactgcagcccggtggcgaaatcaaagcctccagcagcaaacagcgcgcagtattcgcccagggagtgaccggcgaaatacgccacctgctcgttcccggaagcgctctgcaaccgatccaggtacgtcagcgcactgaccgtatagagcgccggctgggtgtattcggtctggttcaggcactgatcccggtcttcgagacacaggtcgacgatggagtaaccgagaatatcgctggccagcttcgtatagcttttgaacttatcgaaaacctcttcgcccatgcccttgagttgcgaaccttggccggggaaaacatagatcttttgcattcaatcacctttttgcaggcacaactggccctcaaattaatattggattcaggtatgtcacacattcagctgatagcagaactacacagcttgcaagaacagctgcaaggactgatcgaccacagagaagttaaccaatccaatcaacttgacaatcaaatggctattaacaatcgaagctcaacgtagcacaggagcctaattcttccagtgaaatcgcgagaccaactctaaaaaaaatttcacgtgcgcccaaccgcagaacgtgtcaagcccggtatccggcacatataaatcactacaaaaaatctcaaactcattaactaaccatttaatttaagcctcaaaaatccaaacccattaactaaccatttaatggaaacccatttgaattacccagcgaaacatgaagcaattaacattttgataaagttatgccctgaaggggttgattgttttgatcgaatcgcattacccaaagagcaaaggggatgcccgacgcatctgttgcgcgccatgttgcgggctcacttgacgcagaactgattcgactacagcgatctggcggtggaagacgccctctacgagaccacgaccccgtgccagctttcggggctgcctgttgggaagacatgaattggcggcggggtcttgcagttcatcaacggttatccgggtggccgtggcaagcgatccggcgtgagcgcttcttggacgagatagagcaggtcgttgcagcctgactaaaagcaaacggcttccaccaaacccggggcgattcagggtccgggattagttgactacggtattcacctgaatatgacgattctctcatcatgaaactttttttaacgagcaacccattatatattggcaaaatactaaaaccctggatgagcttgcatgagagatatggcacgcgacagcctgagcagcaaagatgatgttctgacgaccaaggtgattaaaacatcccaatttaactaaccgtaaagttcataaaatccggcccgacagcctatgaaccgctgaaatcgagacccaacttctggtgtgtgattacaagcaggttctttcgagtcattttcgaatgacatttcagagtaccccttcaatccagccctccaccgctcgacgcgcctgacacacttgcgcagcgatactcttgagctgatctcatttaaacaaactgtgcgaggctcgaactatgtcactgctaacaccttctaaagggtggcgctcctccagcagtcgactgctggcgctgtatagttttctctttgtgacctggagctgcatcctcatgggcgtgctctactacaaagtctccacctacctggatgagcttgccgacgaatcgctgacgcagcgcaaacatttattcacgcgttttgagggcaagcaactgaacgaagccctctccaccagcctggcattcgatacgaacgaagcggatacctatggcctgttcgatgagaggaaaaaaccgttggacgggccgatccggcagattcctgcacagctgcttctggacggcaagactcacgagctaagccgttgttccgaggccgaagacaccacgctgcctcaggacagttgcgacgccgtggccatacagacccatgatggacgctggttggtcctggcccgagatcacgggtcgcttttcggtattccgcgaatcatcgtgcaagcgctgctttgggggctatctctgaccatcattcccggcattatggggtggcacctgttgcgccgccgccctctgcatcggattcgagtgattcaagccagcgccgagttaatcattgcgggggatttgacccagcgcctgcccctgtcggatcgacgcgatgaactggatatgttggcggccattgttaacgccatgcttgatcatatcgagcggctaatgaatgaagtcaaaggtgtgtgcgacaacattgcccatgatttgcgcacgcccctcacccgcttgcgcacgcagctctatcgcattcaacaacaagcggcgaagaactcgcgcgaagccttgcaaatgaaccaggtgattgccgaaaccgatacgttgatggcgcgttttcgcggcctgctgcgcatctcggaacttgaagatcaccaacgccgctcgggtttcgttcaattcgagatgctcgcgttgctgcaagagcttcatgacttttacttaccgctcgccgaggaagaccgcctcacattccaattgcaggtcccagagtcgctgccacccttgacaggtgatccggcgctgctgtttgaagcgctggccaacttgctgaacaacgcgatcaaattcacgccgcagggaggtgaagtcattcttagagccgacaacgacaagggcagtatccggatcgaagtgctggactccggtcctggcattccgcctgccgaacgggcctcagtgtttcagcgcttttatcgcggcggcaataacagtcaacagggtggcttcgggcttggcctgtcgattgtggcggccattacaaacctgcacgggttcaagctggaggtcggtaccagcgaacgtggcggagctcgattgacgctccattgtcgacaggactcgagggcagtccggtatggtcaacgctgatcagctattgaagtcatgtccgaaacggcattagccatccactacgcaatttccccaccctgtgtcatccattgaatcgatcctcggccgactgtcaggatgatcgactccaccatgggtggcattgctgagccaaaaaggcggcctcagccgcctttcacgcatccagcccctacgtggtcgaacttgcaaaaggatcgacgctcggatcgctgttccaatgatattcggcggcatttgccacgtacatagagctatcgggtccgaatagcttggcaatcaatgccagggacatatcgattcccgccgagactccggaagaagtgaaatactttccatcctccacccatctggcttgcttgacccatctgactttctgtccctggtcagtggcccatttgaatgcctccttgttagtcgtcgctttcaatccatcgagaagaccggttcgagcaagaatcgccgctcccgtacaaatactcgcgacatgaggggtctccagagcaagctgctttactggctcgacaagccgaacattattgacttcatgccgagttccagcaccaccaggtattagaagaacatcgagcttaggagaatcggaaaactgactcgccccgggtttcgtggaggcctcaactcttgagaagatgaggccatgagaaagactacgacctattcccctgaagtccgtgaacgtgccgtgcgcatggttctggagcacctgaacgactacccgtccgagtgggcggccattgaggccattgccccgaagatcggctgtgcatcgcaaacgttgcatggctggattcgccgtcatccaaccgatgccggtcagcgtccggggccgaccaccgaagagcgcgagcgcatcaaggctctggagcgtgagaaccgcgaactgcgcaaagccaacgagatcctgcgtctggccagtgcgtattttgcccaggcggaactcgaccgccgtaccaagtcctgagggcctttgtcgaccagtaccgtgaccgtctcggggtcgagtcgatctgccgtgttttgcagatcgccccgtccggttaccgcaggcatgcggcccaacagcgagagggcattgggatcgccagatgcacggtggagcggctaatgcggcaggcgggattgcagggtataaggcgcggacaggttgtgcggacgacggtgcccagcgacaaatcgctgtgtccactggatcgtgttcaacgccagttccatgccgaccgtccgaaccagctctgggtctcggactttacctatgtctcgacctggcaagggtggctgtacgtggcgttcgtgattgacgtctttgcgcggcgcatcgtcggctggcgagtcagtaccagcatgaagaccgacttcgtactggatgccctggagcaagccctgtatgcccgccagccacaccgtgccgatggactgattcatcacagcgaccgtggcagccagtacgtctctattcgctacaccgagcggctggcagaggccggcattgagccctcggttggcagcaagggtgacagctacgacaatgccttggccgaaaccatcaacgggctgtacaaggccgagctgatttaccgtcaatcatggaagagccgcgaagctgttgagatggcgactttgaaatgggtgcactggtacaaccaccaacgcctgctgagctcaatcggatatatcccgcccgcggaggctgaggcaaactttcaccagcaacaagcaggtcaggccatggcggcctgacttaaacgaaacggcctccacaaaagccggggcgattcaccttctattttctgaaccgcgtttagtgctccattaccaagctgaactcatcctctcccaccgccctgtcctaggtatgctggcagaccgaaacatccgtgcctctcagcttccaccgattctattcgtcatgctcattccttcgactggcggtgatgcagcaacagatcctcagtaaattcgccctgctagcccagactcagccgcatgaccttagcgctgtaaacccagctggaagatgtgcccgagcgcagcgaacgaccgccgcaagcgcatgccatctgtcgggttcgatagccaggccttcgcaccgatggagcacctttacgccagattgaaagtctcgatgcagaacccacataagtaaacgcgataaaacaataaaaaataagcgactaagacactaactctaccactcgtcggaaccgccactttataaagctgaaggcaccttgcttttacctgtttacaagcttgactgtattcctagccatgatcgaaagggacaataaatatatcagcacaagaaactgacatcgtccttgacgccgacatcaatcgccttgccgtcaatactccacaacttctcaatgagtcaacctaactaccgtttttccgtagcagtggcaagtctgcaacttgattttaaatagggagccaactcatggaatgtacaatcaaaaaggaatatgaacatgagcatcacagtcaccaacggggcaagcacagtagttaacgtggcaattagtacatgggaaaaagacggcagtgacgcttactggccattagagcaaggcaaaggtgatacctggaaacgtagtgacccaaggggttacttgatggccatacaggataaatcccaaacaactgaatactacgtcacctgcaacagtgtaattgtcatcgaagacaacctcgtgaaggatcacggccggactcttaacccagtcgccgcggccgggaagaaaaatgtggtaaatgcgtaatacctagcagtaagcgcatgtacaaaatggccagtatcgtacaagatgctggccatttccgcaggaaaaaagcaacccattcatcctactagcgactaccagaaaccttcatatttagttgagctcttatggctcaatacatctagacaaaagcacttcactacttgtctctggaaactcctttgcgataacgcctgatacacagcaaagcaatcagttccagatcgccatcgtcagtaattctgatagttcgttgagcattcggccggacacgccaggcgcgtgtagtcccatgaaccacgccaccgacgctggagacagcaggcacattggtgcaacgggttggacctactcgttatgggaaggtggataagtgattacgcattttgatggaggtagcaggccacaaatagccccaatgaactcatccaagagattcttggaaggaaggacaaagcaccacggagcccagtcccctattaaaagcgatggaacacctgctttcctccagccaataaaaaagcccgtagatcgttgatctacggacttttcagtttggaggccgaggtcggaatcgaaccggcgtaggcggatttgcaatccgctgcataaccattttgctactcggccaaactttcgatgctttgcaaccgcatcaaatgcatacaactcgaagctggaaacctgaacttgatctagcttccaaccctttgaattctaaggggtttttcgcgttcccgaatcaggaatggacgcaattctggacttgttcatcgggcatgtcaagaacaggaataaaataattcaatgcgttgcgcctgcatgggtcatcactggcgcaagccgcttgcttgcatcttttggctttgcggcgaggcttcgaaaggctccccccacccgcgcgcccaccttaccggccgaaagaatccacccgcgctatcagggcccgcgataagcggcgaacgatggtgcagctgccctggcctgcgcaccgaagctctcaattaattgctgcactctatgcagcagtcaaatgcaaacagaccagattgttgagcctctagcacagccctatcctcgtttcctgcatcccagcttcctaccgcaaagcttccaaggagatcgagcatgctcacccgcatacagcttcaccaagtcggcgcccctcaggtcctgcagttcgagcaggtgcaactccaggcgcccggtgccggcgaggtctggctggagcagacggccatcggcgtcaatccgctggacctcagccagcgcagcggcgcggtgccggttgccctgccctgcgggctcgggctggaaggcgcggggctggtcaaggcgattggtcccggcgtcacccaggtccaggtgggtgatcgcgtcgcctatgccaccgggcccctcggcgcgtatgccagcgcccgcctgtacccggccgagcgcctggttaagctgccgccggcgctggcctcggacgccgccgcggcgctgctgttcaagggcatcaccgcccagtacctgctcaagaccacctaccccgtcggtcctggcacgcgggtgttgatctatggcgccgccggggccctgggccagttgatggtgccttgggccaagcacctgggggccacggtcattggcgtcgtctccaaggcgcaaagcgtcgagcgggcccgggccgccggttgcgacgaggtactggtgttcgacgccgcgaccctcgcccgacaggtcgtcgaggtcactcaagggcacaaggtcgatgtggtgtacgacccgatcggccgggtgtccttcgcagcctccctcgacagcctgcgtccccgtggcttgctggtgtccttcggcgcggcgtcgggcgctcccgaggcggtgcaggtcggcatgctcaacgccaagggctcgctatttctcacccgcccgtccctcgccgcccacaccgccagcgccagcgagtaccaggcgcgcgccgccgatgtgctggacgccttcgccacgggtatcatccagccccggatctggcagcgttaccccttggccgacgtggcccaggcccacgccgacctgcacgacggacgcgcgcaaggcgccatcgtgctgataccttgaggccgatcctttccgtcccttccggccatttggccgcacaacgaggcagcccaggcacatggatccgttcgacagccgacaggccgatgaactcgccaccttgatggcgctcttcgagcacggctctttcgccgccgccgggcgggccttgcagcgccacccttcggtgctgtccaagcgcctggcggcactggaaagccgcctgggcattcgcctggtgcagcgcaccacccggcaattgcgcttcaccgatgaaggcgcgcggttagtggagcgcttgcggcaggcggcgggcctgatcagcgcagccgaacacgaagcctcccagggcgccgcgcagatccgcgggcgcctgcgcctggccttgccggccgccatgggccggcgctggctcagcccgatcctcgccgagttcgccctggcccatcccggggtggcgctggagaccgagtattcggaccgcttcgtcgacatcgtcggcgaaggtttcgacgcggcgatccgcatcggcgaactggccgacagccagctggtggcgcgcaaactctgtgcgcaccgacgcatcctctgcgcgtcgcccgactacctgcaacgccatggcgaaccacggctgcccgccgatctcgccagccacaactgcctgggctttaccggcctgcgctcctggcccgactggcgcctgacccgccagggccggctggaaaccgtgcgcgtccacggcaccttgcagagcaacgacaacgaagcgctgctggccgcggcccgggccggcgtcggcattcttgccggcggcgactggctgatgaaccaggatctcgcctcggggcatctggtccgggtgctgccgcagtggcagctggacagcgactcggggatcttcctgctgcgcccgtcggcgcgcttcagcagcgccaccacccaggccttcaagcagtggatcgaggcgcgctttgcccagggcgcgccgtgggaaacgccagccagggacgagccgtagcagcgttcacagcgaactgacgatgaactctcgcagccactgatgggccgggtcgcggtggcagcgctcgtgccagagcatggccaggtcataacccgggacttccagcggcggctcgaccaccttcagcgccgggttgtcgcgcaccaggcgcgccggcagcatcgccaccaggtcggtgctcgccagcgccgagaggacaaacagaaaatgcggcaccgacagcaccacccggcgcgtcaggcccacctcgcccagcgcgctgtcggtgacaccctggaaaccaccgccatcgggcgacaccaccacatgttccagcttggcgaactgcgccaggctcgggcgtcgttgcaggcgtggatggcccgcgcggcccaccagcacgtaacgctcgctgaacagcacgcggcggcgcagccccggcggcgagtcctcgctggtgtgcagggccaggtcgatgatgccctgttcggcctgccgcaccaggcgcccgggctccagttcgataaccgccagccgggtcccgggggccgccgcgcgcaagccggccagcgccgggaggatcaccgtcgactcgccgtagtcggacgccgacacgctccaggtattggccgccacgcccgggtcgaacgggctggccggcgacaccgccagctctaacgcttccagcgcccggcgcaacggctcgcgcaaggcgtcggccctggcggtgggccgcatgccgcgcggccccggcagcagcaacgggtcaccgaagatctcccgcagcttggccaggtgcacgctgaccgagggttgcgacaggttcgggcgttgcgccgtgcgggtcacgttgtgctcggcgagcagcacatccagggtcaacagcaggttgatgtccaagcgccttaaattattcacgacaatacctgggatattggatattcatttccaatatacctggcagcggccgatcctgctgtctcccgacattggagatcctgtgatgaatgtactgctggtgtatgcccaccccgaaccccgctccttgaacggctcgctcaaggacttcacgatcaagcgcctggaggccgccggccacgcggtccaggtttcggacctgtatgcgatgaactggaaggcaccgctggatgccgacgacagcctgggccggccggagaacacccgcttcgatccgtccctggactccaagcgcgccttcgaagagggcctgcagtcggcggacatcgcccgcgagcaggaaaaactgctctgggccgacaccgtgctgctgcaatttcccctgtggtggttctccatgccggcgattctcaagggctgggtggagcgggtctacgcctatggttttgcctatggcgtgggcgagcattcggatgcgcgctggggcgaccgctacggcgaaggcaccctggcgggcaagcgggcgatgctgatcgtcagcgccggcggctgggaatcccactatggcccacggggcatcaacgggccaatggacgacctgctgttcccgatccaccacggcatcctctattacccgggcttcgacgtgctgccgcccttcgtgatctaccgcaccgggcgcatcgacgaagcgcgtttcgccacaatctgcgaccagctcgggcagcgcctcgaccagttgcaacagaccgcgcccatcgccttccgcccgcagaacgccggcgcctatcggatcccggaactcaccttgcacccggacatcgccgcggaccgccagggctttgccgtccacctgctgtagcgtcgctgcccggctcgctgccaaccgccgcccaggaccttatacctgcgccgccagaaatcttgcagatgcacgacgcagcccctctggcgcgacaaccggtaaaacggcgcagaggctcaggcccgcgcctggacgctcggcaccagcatgcgcaccagggagtcggcggtgtcgcgcaagcgctgcggctcctggtagatgcgttccatcaccgccagcccgcgggtgaaggtgaccatgacctgcgccgcttcatccggcgccaggaccaggtcgccccggatccgctcggccgacagcgcagtgttgatagtcagttgcagggcgtccagcagctcgcgcaagcgttgctggatgcgtgggccgatcgcatcggcttcggcggccgtcttggtggtcaggcagcctttggccggcgtgccgctggtcatgttgctgatcgccacttcgaaaaaacgccgcagcgcggtctcggcatccgcggcctcgagggccttggcggcgttgcccagaaagcgcgtggcgtaggcttcgaacgccagcaggaacaacgcttccttaccgccgtaggcatggtacagcgagccgcgctggacctcggccgcctcggccaggtcggccatggaggtggactgccagcccttgcgccagaacacttcaaggaccgccgacaacactttttcttcgtcaaactgcctgacacccgccataaaaatcactgctcacataattgttgacaacgttgtcaaagataccaacactgcgatccttgacagccctgtcaatcatagccgataggcgctgtgcggtaagcatgcttgatgtactggtccacgactttcgttccgcgccacggaaggaagtcggcttcacctgcgcagtcacgcccggtaacagcggtcgtgggcgcgagcggttttctctttttacgtcaggaaaaaggagtcttcgaaatggtttcgaacagtcgtatccagtatggctacatcaatgtcatcgagccctccgagcacaagggcgagctcacccgcgacaaggtcgagcgcttcaccgaggggttcagcaaaccggccctgctgcgcaaactcgcgcccatcggcgaggagttcgcgcaacgggcattcttcgatcaggtcggctcggggaaaaacctgcaatggcgggtcaagtccggcgaccagccggtgtcgatgcgcgacgagaacggcgcctcggactacaactacgtcaccggccgcgtcggcaccgggcaggaattcctcgacgacatcttcacccacaacctcgacgtctactcgcacctgggcaccatttcctcgagctacaacgacccctacgagtggggcaaggacgccttcaacctggtcaagcagcacgtcttcagcaaaccctggttcaacatcgacgcctggaaagtcaccggccacatgttcctcggctacagcacccaggaatacggcgagccggcccgcggcgcggtgggcagcgactggcacattttcccgaccctgaatattttcgtgatgatcgccggcaccaagaaatggagcacccgcccaccgcagctgggcgaccagttccgcgactacgacctgatgttcgaaaccagcagcggccgcgaggcgccaggcggcgactacgaggccgacaccgtctacgtcgagccgggcgacgtgctgatcaacccgcccttcgaatggcacaaggtgctcaatgcccgtggcctgagcatcggcgcggcgttccgggtgatcgacatcgactatctggacaagctggagaaccgccgcaacctggacctctccaaggtcgcccatgacaacggccacttcgccgagaccgaggagctggcgcacttcctcaccagcgtcaactacgcctcgcgtcacatcaaccgggcgcagatgctgctcaacgacatcgagtacgcctacctgcgcaagcgcggcaacgccggctcggtgaagatcggccaccgctagccccgggcatcgcagcgaggacccgctcatgacgctcaccgtcagtcccgaacagcgctgggccggcattctgtgcggcctcgccgcggccttgatctggggcgcgttcccggtggtcacccggctggggctgacgcgcacgccgctggatgcctacgacatcacctgcatccgctacagcgtctcggggctaatcctgctgccctatctgctccgccatggccgccggggcctgagctggacaaccatcggcctgatggtcgtcggcatcggcgcgccgtacatgctggtggtggcccaggggctggccctggccccggtggagctgttcgcggtggtgactcccggcagcatgatcctgttgtcgatcctgatcagcgcgcggctgttcggcacccgcctgggcgcccgggcgaacgccggcaccgcgctgatcatcggcggcgtgctgctggccggctggcacagtttcgccggggcccaggcctcgccctacgcctacctgatgttcctgctcggcggcctgctgtgggcgatctataccctggtgtcgaaatggtccggcagcgacgcgctgcacgccaccgcgatcgtctcggtgtgctcgatggtcctgtacctgccggtctacctgggcagccgcgggctgcggatcctccaggcgccgctctgggatatcggcatccaggtggtctaccagggcctgctggtgtcggcggtggcgttgttcttctacagccgctcggtccagttgctcggcgctgcgctcggttccaccttcgccgcgctggtgccgggcacggccatggtgctggccgccctgctgctcggcgagcgcgcggacaacactgccatcgccggcttgctggtggtgaccgccggcatgctcctgaccctgctgccgcaacgcccgcgcccgcagccgggcgccatcggccagccgacaccccggccaccaggacccacgccatgaacgacctgcatgagcggacagcggccactgtccacaaccaaggaaaacccagtatgagcagcgcacccctgaccctctacgaactggccggcgccgacccggacctgcgcttcagcccgcactgctggaagacccgcatggccctggcccacaaggggctgcaaagccagcgcatcgcctggcgtttcagcgacaaggcgcgtatcgccttctcccgacaaggcgcggttccggtgctggtggatggcgaccagagcatcagcgactcctggcgcatcgccctgcacctggagcagcgttaccccgagcgcccgtccctgttcggcggccgcgaggccatcgcgctgtcggccttcgtcaaccgctgggccgacagcatgctgctgcccgccgtggcccgggtgatcctgctggatgtctacgcgcaactggccgccgaggaccgggcctatttccgcagctcccgcgaagcgcacttcggcacctcgctggaacagctggtggccccccaggcccagcatctggaacagctgcgccaggtcctgaccccgcttcgccagaccctcaagggccagcccttcctggccggcgaggccccggcctacgccgactattgtgtgttcggcatgttcatgtgggcgcgctgcaccagcggcgaagaactgctgggccccaacgacgccctgcatgcctggcgcgaacgcctgctggacgcctttggcgggctggcgcgcgcggccaccctggccacccccctcgagactggagcacgccatgtccaatgatcccgccctgcacgacttcgccgtccgttcctcggacaagatccgctacgccgataccgaccgccagggccatgtgaacaacgcggtattcgccaccttcctcgaaaccgggcgggtggagatcatctacgacccgcacgcgccgctcgccgagcccggcagcgaatttgtcatcgcgcgcctggagctcgacctgcgcgccgaactgcgctggcccggcacggtgcagatcggcacccgggtcgccaccctcggaaaaagctcgatgaccctggaacaggcgctgttccaggacggccgctgcgcggccctggccagcaccgtgatcgtgcagatcgatgcccagagccggcgctcgaaaccctttggcgaaacggcgcggcgccgcttgggcgccctgaccacggccgcggagtcgttcgcggaaaaataggcggaggacgccatgtcgacgctccagcaactgttctcggccctgccatttttccagctggcggtgatcatcgtcgccagccagctgtgcggcgcgctgctggcccgctgggggcagtcgcgggtgatcggcgaaatctgcgtgggcatcctgctcggtccctgcctgctgctggccctcggcgcgcagtggcatgccgcggtctttccgacggccatccgcctgggcatcgagaccctgggcaatatcggcctggtcctgctgatgttccagatcggcctgcgcttcgacagcaaccacctgggcagccacaagatcggcttcagcgccctctcggtggccggcggcggggtgatcctggccttcgccctcggggccatggtcgggctgctctcccacagcgccctggcgcccgcccaaccccggctcggctacgtgctgttctgcggcatcgcgctgtcgatcaccgccctgccggtgctggtgcgaatcatcagcgacctggggctggagcactcgctggccgggaccgtgggcatcgcggccgccgccatcaccgatatcattggctgggtgctgctgacggtcatcgtcgccctgtccagcagcgacagctcgctgttcggggtgctccgccagctgagcttcatcgtcctgttcctcgccctcgcccgctggggcctgcgcccgctgctgcacttgtttacgcggctgcccgcgacccgcagcgcggcccccgccgccgatatgagcatggcgctgatgctggcgaccgccctgctgtgcggctggatcaccaccctgatcggcctgcacagcgccctgggcgggctgatcgccggctggctgctgcgcgagcggcgccagcactggcaccgccacatggaaggcttcgtcaatatcgggctggtgcccttctacttcgccgccaccgggctgaagatggacctcggcgccctggcgccgctcgacagctggctgtggctgctggccttcttcgtcgccgcggtgctgggaaaaaccgccggctgctacctcgccggacgcctggccggcctgtcggtggaggtctcgcgcagcgtcgcgatattgatgaacacccgtggcctgatcgagatcatcgtgctctccgtgggcctggacatggggctgatctcccagagcgcgttcttcctgttgctgatggtggccatcgccaccaccctgatgaccaccccgttgctccggcgcctggccaggatcgaggcccttccatccgccctggcgaaaggcgagctgcagacttccgatcggtaaatatcgagcgaccggaaaggccggaaaaaaccaggggctacactcgcagcttgtgccttgcctgcgcccgaaagcctggccgggcactggacttccctcgccaaccacaggaggtgcggcggccatggccttcaccgaaatcgactacgaaacccagggaccgatcaggatcatccgtttcaaccggccgcagaaacgcaattgcatcggccccaccacccaccaggaactgatcgaggcctggagccgttttcgcgacgatccgcacgccctcgtggccatcatcaccggcgccggcgaccaggccttctgtgccggcggcgacctcaaggcggcgctcgacctggtgcccaccaccgcggatgagatcgccgcgcacaatcgcggcgagcgccccgggatcatcggcccgagccgctggacggatatctacaagccggtgatcgccgcggtgaacggcgtggcctacgccggcggcctggagtgggcctgcttcgccgatatgcgcatcgccgaggaacacgccaccttcggcgtgacctgccgccgctggaacatcggcctgggcgatggcggcacccagcgcctgccacgcatcgtcggcatgggccgggcgctggagttgatcctcaccggcaaggtgatctgcgccagcgaggcgctggctatcggcctggtcaacgaggtcgtcgccaagggccactcgctggagcgggcgctggaactggcccgcctgctctgcaccctgccccagcccgccatgcgctcggacaaggaagccgtcatccgcggctacggccagcccctggccgagggcctgcgcatcgaagccgagtgtttcaaccgctccatccatcagccggaaacccaggaaggactgcgccgcttccgcgagcgcgaccacccggacctgcgcgacgacataccggcccagacgccggggttgaccagggattgagggctgcggtgttacatgcggggctcacgcagcggcttaagcagaggcgacctacgccctccgtttatctccgccacccagactattatcgacattccacccatacaaccactgcaccgcgtcatgaaactgcgcctctcccacaggctgttgcgcacgctgcgttcgacgccctgggcaggtactggctcatagggtgggcgacgtcgccgagcagagtggcattgccctggccccagcgcgtcaccggctcacggtcggcggtggcccaacggcgccaagggctaatcgaacactactccactgcccagaacccaagacgccctaggctgctcgccagtccaagacgagcaatctgccaaccgttcaatgcatctatgtggagctcctgggcatccacaaaagcactcatcgcgccgagtagttccgtcatgctgcccacaccagactgatatcggccacgtatcaccatcaacgcttgccgggattgatcttcaatctccgcagtacgcagcaaactctgcgtttccgtacgtagcacttgatagtacgtccagacgtcaagagaaacacgctggcgagcatccgcgagatccgccatacctgcagtgacacgagcttgcgcgtctcgaacttgataagtgcgctcaaatccgtgaaacaaaggaatgctcagctgaaggcctatgcttcgatcgttctgcctgatgtccgaacccaacgcagtagactggccattctgtgcttgtctgatattagcggtcagcgcgatgctgggtcgcccataggctcggctctcctccactgacgcttcagcagccctcacacgtgcttgagcggctataagcgtaggatgctcgtcacgtgcgatcgcgaggagttcatccacggaagtggcgaaggtcgcatccggtagcgtgttcaagccattctcaatccgtagggaggtattaggcgtgagccccatacgtaaggccatcgtgccgagaagcttttccagttcacctcgctcacgaacctgtcgcagattggcccgagacaaagcggtctgcgcctggagttggtcggacaaggccacggtacccgccttgtacttggcatcggctgcttcgaagttctttcgtgccaacgcaaggacttgctccgatgccgtcagtcttctgcgtccagcttgagcttgatagtagatctgcaccgcttgaaagaatgtgtcctgcaaaactgcttgttgatgggcatttgcggccaacagcagttgctgagcgccagataaagaagcttcgcgacgaccaaagtcgaaaagtacccaactgagcgtcaagtcaccattgcgcgtgcgtcgagctccggagttggatcctcttccaccgctgcgctccacatcgctatatcccgctcccgcaccaagctgcccatccaatcgcggcaaataggcagaacgtttgatacccacttgcgctgcttgcgctatcgcttgagcccatgcttgccggactgcgggctcgtgacaaagcatgcgttcaactgcttcgaccaaaggcaggggatcagcccccccccaaatacgcacggtacttgccgcttgtcagggagcgaaataccaggaggatttgtttcgaatacatccatcgcactggacgaatccagaggtgaagcgaagagcatccccgcaatcagcgatgttacaagttgccgcctcactttcgaggaggagaaactactgacgtcgcgctcaaggactctcaaagccaagcgaacactcattcgggtagcaggcatgtttcggacacttgagcagttgattgcaaccgtgtgatatcaatcacccgctccaccatggcaatggtttccggccgatgtgcaatggtgattcgcgtgataggcaagctgcttatggaggcattgacctgacgctcgcgctcgacgtcaaaatggctggtcgcttcatcaaggaccagaacgctcggctggcgatacaacgcgcgagcaagaaggattcgctggcgctggccaccggagagggtgttgcccatgtcgccgttgagcgtgttgtaacccattggcatggcatggatttcttcatgaataaatgccgctgccgctgcagtctggacacgatcgatgtcgatagtttcaatcccgcgatattctccttcagactcgcagagaaaagctgatcatcctgcatcactgcgccaatatgacgccgccagtttgcaagtccgatatgtgctaagggatggcctcctacccgcacggtacccatcgtaggctctagtaagcccagaatgattttcgccagagtcgtcttgccacaaccggtagggccaatgatggctacgtgttctccggaacgaagcgtaagcgtaacgttcttcagcacccactccgccccctcggcataacggaagctcacattctcgagttgtatttcgggggccagccaaccgtcggtatcaaaccgttcaggcatggcacccgctgttttctctggctcagtcagaacgatgtcggacagacgctccacatgcaaacgcagcatccgcatagacatcatattgtcgataaacctttgcatcctggacgagaactcgtccttatagctgatgaatgccatcagcatccccacggtcaaggtgccttcaatggtcatgtaggcccccattcctagtacagcgacggtctccaaaccaaacaagaggctgtagctggcgctgaagacgagtgtcatcctgttggcctgcattcttttgttaatggcacgcaccatcaggtttgaccatctggaggtcctttgctcttccagaccagcaatcttgatgctctgcatcgcgcgcaggctttccaggaaatgagtttgcgaaatcgcctcgtgggtcatggcctcgtcgcttagacgatggaacgcaccatgagtaaacaggcgtattgatgcatagcccgtaatcgtacccacgacgacagcagccagaattggactgtaaataaccatcacaaccgcggtcacggtggcaaacagaccatccagaacaatatcgacgaactttcccgttacggtttgctggatgctttgtgcagactgaaagcgcgacagtacatcccccgtatgccgcacctcgaaccacttcatcggtaagcgcagcaggtgccccaccactcgcgatgcccattgaataccgagctggtaagtagcaatgacaccgagccagccacgcgtccactccagcaccacacgcatgatcgtgaccatcacgaaccccgtgatgacaacccctatcagcccggtatctccagcaacaacggggccatcgataagccattgagtaaatagcggcaacaccagtgccactacctgcaaggctcccgcgaggataaagagctgcgacagacttcttctcaggccaacaatcggccccatcagccctcgccagttgactgaagacttcggcttgatcttttcgaactctgcggggggccacaactccagcgccaccccggtgaaatactgacccgcctctgccagagacatcgagcgctcccctcgtgcagggtcataaaccctaatcttggctccattagcttttatgagcaccacaaaatgcgtcaaatcccagtgcaggatgcagggcaaggccagcttggaaaacccttcgagttcgagacgaacaggcctggcgcccagccccaaaagtcccgcaaatcgaatcaggtcgcgcagatttgttccccgaatagaaacagcaaatcgcgcccgaagctcgttcatcgaaaactcatgcttgtgatgagctgcgacatatcccaagcaggccaatccgcactctgccgccgcggtttgcagataggaactcactttatcgacaccgtgttggcgattggcaatatgctgtccaagacccatgcttgaaccgcttcggtatcgttgatgtccccggcgaagatgaacttcggtgtatagggctcgttatctttgcgcttgcggttctggtagaccttgagcggcaaccaaattttcagagcgcgtggaagcgatagccacgcgacatctgaataccttgtgtctgcgctggtcacgctacccacatgaaccactccgggtatcttcagcaccatatccacgaagtccagacaagcgctcgcacagttcgagtcggtaatcagtagaagttttccagcaaagggcctacctgactctgctagctcatcgaccggtatctctgcttgctcgacgaatgcctgtccacgtaacgcggcttcctccatgcttgccaggagggtatccagaaacttgtaggtcgggccgtcagtgccttccgtctggctgaagtttcccctataggcttccagagtctcacgggcagtaatagaaacgcgccagtacgctttcgattccatctgatcttttggggctcgctcaatggcccccttaaatagcgccaacagcagccggtaacccaccaacgtttggcctccgttgttgccacgggtatcgagcaccaccgcatcggttccgtccagatcgcggaccttgttcaacaatctttcgtacgatgcaatcgactttgcactcgacaaggtgaaatcggtggcatgaatccagtggatacccggtcgtaattgtttgatgccttggcgaggcgtgaccggccaggtcattgcttgcaacgcatccgagaaggcctgccacttcagtggaaactgatggatgcctcccgaaacggaacgaacctcgcaatgatgcaaccgaaggctcccacaatgtttcatagggcggctcgctggtcagatgccgtgcaagtcgtgacagtgtgccttccaactccatacgtctatccacgaatggagccactctttccgccagcagcccgtcgatggattggccatcgcaagaaagcagttcagcccctacttcgggcacatcgatcggtcaatccgaagcactagccgtgacacggtacttgccgttttgccgctgcacgatccatcccgcccagagcggagactccctgacctcgccctccttccatacgaccaggtgcccgtctctatagcctgtggtgtagaagcgtaatgccgccagcgccttgccctcggagtctgcctgccgagcaagttgtatggcttcgtcatacccttgtctgaaccactgttgaaagccgtcatctgtcaagctcaggacaccaggatgcacgtcccggataagctcatgcgcacgcgtgatgtcttgaatggcggtattgctccaatcgatcgtcatagggaaatcttccgtctttgggatgcctatcttcgttgtcatctccgcctgacatgacaagccaaatgcaagcaacaacgtcagggtcacaagacggattgaatcgccccggcttttgtggaggccgtttcgtttaagtcaggccgccatggcctgacctgcttgttgctggtgaaagtttgcctcagcctccgcgggcgggatatatccgattgagctcagcaggcgttggtggttgtaccagtgcacccatttcaaagtcgccatctcaacagcttcgcggctcttccatgattgacggtaaatcagctcggccttgtacagcccgttgatggtttcggccaaggcattgtcgtagctgtcacccttgctgccaaccgagggctcaatgccgcctctgccagccgctcggtgtagcgaatagagacgtactggctgccacggtcgctgtgatgaatcagtccatcggcacggtgtggctggcgggcatacagggcttgctccagggcatccagtacgaagtcggtcttcatgctggtactgactcgccagccgacgatgcgccgcgcaaagacgtcaatcacgaacgccacgtacagccacccttgccaggtcgagacataggtaaagtccgagacccagagctggttcggacggtcggcatggaactggcgttgaacacgatccagtggacacagcgatttgtcgctggccaccgtcgtccgcacaacctgtccgcgccttataccctgcaatcccgcctgccgcattagccgctccaccgtgcatctggcgatcccaatgccctctcgctgttgggccgcatgcctgcggtaaccggacggggcgatctgcaaaacacggcagatcgactcgaccccgagacggtcacggtactggtcgacaaaggccctcaggacttggtacggcggtcgagttccgcctgggcaaaatacgcactggccagacgcaggatctcgttggctttgcgcagttcgcggttctcacgctccagagccttgatgcgctcgcgctcttcggtggtcggccccggacgctgaccggcatcggttggatgacggcgaatccagccatgcaacgtttgcgctgcacagccgatcttcggggcaatggcctcaatggccgcccactcggacgggtagtcgttcaggtgctccagaaccatgcgcacggcacgttcacggacttcaggggaataggtcgtagtctttctcatggcctcatcttctcaagagttgaggcctccacgaaacccggggcgattcaccccatgaaagacaggacaccgtttcccccttacgataagggataggcaaacggttatgtttatgactaacagcaacgacaagagtggggagcttttgggccaggagcggcgacgccgctggagcccagagcaaaaactggccatggttcgcgagagccttgagcctggacaaagcgtttcggtagtcgctcggcgcaacggcatcaatgccaaccagctgttcctgtggcgcaagctgtatcaggacggcagcttgtcggcggtcagtgccggtgaagcggtggtacctgcgtccgagttgagcgatgcgctcaagcagatccgtgaactgcaacggatgctgggcaagaaaacgatggaagcggaaatcctcaaagaagccgtggagatcgcccggtcgcgaaaatggattgcgcactcacccttgttgccgggggacgaccagtgaagctggtcagcgaatgtctcggtgtggcgcgctcgcaattaacggttcgaatcaagcaatcgctatcgcccaagacacggcgaagcaggcctgtgaacgacgctgagttggtggccgaaatccagcaacaggtcagcgaactgcccagctatggctaccgtcgagtctggggattgctgcgtcgcgctcgtgaaagccagttgctacctgcgatcaacgtgaagcgggtctaccgggtgatgcgtgatcacaacctgctgcttgaacgccggttcaaacaacccggcgtgccgcgtcggcacgaaggccgtatagccgtgcaaaccagcgatacgcgttggtgctcggacggttttgaattccgttgtgaggacggcgccacactgagcgtgaccttcgccctggattgctgtgatcgcgaagccatcggctgggttgctagcccaaccgggtatagcggtgatgacatccgtgacttgatgctggaaagcgtagagaagcgcttcggtgatcaactgcccgccacgccggtgcaatggctaagcgacaacggctcggcgtacacagccgaacagacgcgcctgtttgctcgacagatcggtttgcacccagtgaccccacctgtgcgcagcccgcaaagcaacggcatggcagagagcttcgtgaagacgatcaagcgtgactacgtggcgtacatgcccaagccggatcgagaaacggcgctgcgtaacctggcaattgccttcgaacattacaacgagcagcattcgcatagcgccttgaactatcgctcaccgagggagttcaggcgcttggcggcagcatcaatttaacggggagttggtgtccggtttggtaggggcaagtccagggactaataagctgatgcaagaaatttctgagcttagagcttgtcgccccaagtttaggaataagttatttccggcaccaacggaactactgataggctaccgccagaataaagaaactcaccagtggtgatatgaaagagaccggcacgtcgaccgatcgttcctccaagatcgataatcgcttgaatcaggccatttgttaacagggattcggtggtcgacgtcgaaaaataacgttgtaatatcaccaaatcctgcgccgaaggtaatgcttgcatcaacaggcagggttcgcctcggtatggctcctctccaagccccaaatgtatttgcagcgtggcgacattgccaatggtcgtgaccaataccgggacggggtcattcccaatgaactccactgcttgcccgccgatcgagaagaactggtgccgcaactgcaagcctgcaaacacatcctccttgagctcgcccagcacaactttaccatcgacgacggagtgctgtttcactgcataatcaatatcaaaaatccattcattgttcgtggtagcgtgtggattcggcctcctgggactatcaatactgatcgaaactggaatagcgggcaggaccacggtgcaagtaccgttgccgccggtgatgtgatagttcagatgctgacgttcgttttcgtcgacaacggtcggtacgatcaacgtccgctgagtggcatccagtatggtatggatgccagtagcttccaaatccacggtgatctggtaaataccccaatctgttggaaaagcgtacataccccaaacgaattgatccccataatactcgtgcaaacgacgcaatgccggtgcattagcggtccttcggccggtcaattgcgcataatccatattgatatggcgatcaaccccgcttggcagcaacacgacacttgcttggctggcatcgaacgattggtttctttgggcgccgaggccggtatacacattcagatacaaagtaggatccggatcgggtcgggccaaataatggtcccagcctcctgtcacggtatgccagcttccccctttggttcccttgattaaaacgtaaccgtattgtgtttcgccttctttaaaatcgattgttttgacgactgcccccggttgaaattgccagatttggccatcctgccgcaagccaggcatggagacgctgttcatgatcgcgtccatatatgccgaggcttgatcgaatccttggcgtagccgttcataattttcgaccagaatgggaacgccgaccgccaagccagccaagggtactgccagagctcctagtacaccagccacggtgccggcgccagccacgccagcaatcagaccggcgatgctcaccccgctgccaacaacagacaagccaagtttggattcaatggctgcacgggcagccaagtctgaggtctgattcaattcgacgataatggcgccgatattgatggcatcaaatgccacatttactcctgcccccattctcccgatgagtgtcattgctttgggcaccaagtttaattccgtgccaagtgctgagcgaatcagctggcccatcctggcgccatcgttgaccaattgaatgccattttgagccaattgtgcatacacttgtactttgagtgcatcgctcattgtcgttagctcgccatttctggagcgcatctcgatcaaggttttcaacatgaaagcggcattcagggtgtgtattgcatctgtttctgacaaatccgaccggatccgtaatccctgttcagcctcatgccatgtgagtccccggctgacatcattgatcaattcatttatttcagcatgaatctgaggataatcggcattgttattggtggtaatccagcgtgacggttctgcgtcgtcaacattggcggttcgacggatgaacaggagttcggtggcgccgctttcggtgctacgactttgcaatgtcggcagccactcattggacacttgatgctgttgcgtcagcgcttgtacggcttcaacccactgcgcggcaagaatcgcgctacgggtatttttaattgcgaattgttcgatagcccttcggtgttccgcgtctgggggatctagatccaagacctgtttgcgaacctggtcgcccacggtttgatgcagacgaactagttctacccgatctgcgtcactaagccctggatggtgaatcacgctttcaatttctccaccggcttccatcaagccgctcatcggcagcggcttgtgcgcgagtgcaccaagtttggcatcccacactagctccactttatgtacaacatccttgagtcgcgcttcttccttgttgatccagccccattccggcgtcagaatttctttctttccatttgcagtgacgcgtacggcatacttgcgcgcgctcagtgacagattgttccgactgatctgcatgccgtcacccgtactgagcaaccactctcccagctcaccgggcaagctggtggctaggggttgacgctcattcagcaactcgcagccgaccaaatccagctggatacctttaatcttatcccgggaggcttgtgccatcagtgcagtcagactagctttcagttcgtcgacgttttttcctccaaacaaagttcgtccatcaatgttaacgccatgtccgaccaagactatcttgacccgtccactgccatagagttgcagcggtgcctgggatctaatatttgtccatgtttctcctgactctaattgtacccattcggtgtgccttgggtatttgctaaacagagccattgccgcattaaaactgacatcatctccctccaattgaacgatcagttgtcgacgaaaattcctcccagaggtcggttcgatatgatcacgatcaagttcagccagttttgtcaatgagggacgccgccatccctgggataaatcgagactgccaagcgcattttcccgcaggcgcaagccgatagcgtaggctcgcgcatgcttcgcaaattcgagtaatttggcagatctatcattgaggttacgggtgtgagtcgccgcgtattcatcagccaattgagccagatcactcaatttccccatctttaccatgacactgaggccattagcttcagtgtggtatcgatcaagttcatcaagaatacgtgtatacgaaggaccatctggtgtacccgctttggcgatcagccgttgtcgatcgtccagagtgtccgggatactgcgggcgccgttgtcgatttcttcttttacggccttgaacggtgtcacttctttttcgaaaaggcgtgccagctcggccagtgttgctgttcgttgttcctccgtcggacgaagagagcgcggggtgagcggtgaaatcgacaactggtattctgcatacctacttccccagcgtggataatcaagatgatccttggcccaagcgcgtgcttcacctaacaatgtccatgccggatcagtcaataggggctcatttgttgcggctaccgcactgttggcgagcgcatgagtcggaaaatcccggaatttaatgactacacgacgaagtctaggcaacgcgagaaattgttcctcccagtttttagcgctatcgataatgggcgtaccgatgcggtgcgtggaaaactgaccggccgttatgtcgatcattacgcgctgctcgtcgatcttggcaatcaccacaaagtgattgccgctggcaccatcctcagcgttctcccatataagcaagcctctcacctcataggcgatattattcgcttgcagaagggttgtaacgcgactcgatgcattttcgcaatttaaaagtggttggctaatatatcggttgatttcagcatcgctcgtcaatgaaccagtgactctgcttagagcctcgtcaaaagttgtcatatagatttccttgtgatttttaaaaaaagccatccatgtaactctcacttacacgtgatggccgtccatgtaaatgctccgcgtgtgtgtcgcacgcgtgcgcaaaattgactgtttggcgaaatttctggtatctcatcagacagtaaatagaggctttttgtgcgcttgatttggctggcatagtatcgggccactaggctacgtgttacagcaggcgaagccgatgcgcggctggcgcagttcgggggtcacagcaggatttactttcttcgtcttatttggctctccataaatccactcattaacgtgaataagcatcattatgcgaattgcactttccaacaattaaagtccagaaataaagtatgaaaaccgccagattcacaatggcaaaccagaaaaacaatagcctcccacctgaatcgttttatagaatacccagatcgccaaagaaagcagatgtctgaaatcaggcaactcgagaatgcacacctgatgaagtggtggtgggtcatcccttcaaacaactaatctgaatggggatcgccaatggcagcgtctgttccttcttgagtgcagcaaacttcgcgggcggcagcaggtaatcttcaaagtcacggaactgccgtgagctattcactcagatgtcgccagagcgcagtgcgtccttcagttcggacaagacgcaaatctcgtagaagcgccgatcaatgccttccggcgtgatcaccacacgttgatcccggtcagcccttgtaagactctctacattcgacttcagctccttgggcaggtcgaaggggcaacgaagagcccggtgcgccccccttggatcgcttattgataacctgcagttgcaacctcgcatgcattgcttgaatttgcgctggaacgataggccttgcttaggttctgcacgaaaagtaatgtcgtaaacaccgcatggcgcaggccagcgagaccatcgccgcataacttttcgcaagcttgtcgaagcgcgtaacgatgcggcggttctccttcagccagccgcacatacgctcgatgatattgcgctggcggtacttgggcttgtcgaacagtctcggcaaccccggtttgggtttgcgcttcatgctgcgcagaggaatcaccggctgcatccgataccggtcgcagtaacgacgcagagattcggcgtcatagcctttatctgccaacaaccaccgacagcgtttacgaggacgaccgcgcaaacttgggatgtgtgcctcatccagcacgggctgggcataagcgatgtcgctggcttgcccgcccgacaacagaaatttcagaggcacaccattcgcgtcgcacagcatgtggatcttggtcgtcaggccgccccggctgcgcccgagcgcatgatcttacggttcttcagactcccttttttcccagcacctgaaaaggcccggttgcgcgtactgcggtggagtcaatcatccaggtccccagatcaatcaacccttgctcgttgagcttgatatgaagccgcttgagcatctggccaaacgttccgcgattacgccagtcacgaaaacgttggtagaccgttgaccaaaggccgaagcgctcaggcatgtcgcgccaggcggcgccggagcagagcacccaaagtacgccgttgagcatcagacggtcatctgttcgcggtcgccccgctacggcgcggctcattgaaaatgtctgcaaccaggtcccaggctgcgtcggggagttcataccgtttggccatcgtgggctcctgcctttgatggacgcggactttactgaatctcgacgccggtggagttcaaattggtttcggctgatttcgtacagagcctagcagtttttagttgtacatctgatcaagaacaaaaaaggcaagtgataaagaggggagaagggctggtcagaatcagttcattcgacaggcgttcaaataaccgcttttattttcagttttggacttgcactgagtcggtacgctacttgccgatttgccctggttcaacagcatgttgcaccgcaagaaacatcccagacgtacgaaccctttttcagtccatgggggagaagaagccaggttggcagtaccgcaatgcggcatcgcccgacgaaatgcttccttccaagcatcctgccaacctgtaggccaagattagcgagggggatttgggttttctgtagggagatcctgaaagttggccggcccccattgacgcccttaaatcgatgagaaagttcgatcatgaatggcacctgtagaggcatctcctgaggcggtcagtctgaaggcccagggctggagcacgatgcccagtaattgagtggaacagtgactgagcggacatcaagcggtcgttgttcactttcgttcgataattatgcagattgcctgggaggcgttaaccccaagtcctctcctgagcagaaaactctggggagggctcagctagcactgagcactctgaatgtcactgcatgacagcgtcctgctcatggggcttttagacacgcaccatttcgggcaagcgtccgcgaccttatagcccccgcgatttattggcctgaactcatgggttagttggtcgatgaatgggctcgcttgtgtgggttttactcactttcaagtcttttgatacgcgggcatccaccgtttttccacccagaaaggtgttttgagtgccggcaatattcggagcagccaactgaccttgatattgcatgcgccattggcctttctcatcaatcttcaagaaggcgaaacccgtaatgttttcgatcttgtcacccagtgagtctgagtggtaaccataatcacaatattccatcgcaccggccatcccaagtccgtgcatgtttttgtctatgttgttgtattgagcgtcctccttgcccccttccacatgccatacccgcaagatgtcttcactcagttgatcaacacagaatgaacacccgctgaaggcaggagtgaatacatacttgactccgccgttgggtttggccgggatatccacataaccaccttgcggagcccaatagcccagaactgtctttccatctctatctggtgccttgccttcatagttttctacaatttgcagagccgaaaatcctggagcgtcttcgccgcagttgaccttcaacgctgtaaataacagaagtcctcctccctctcgtttattcaggacgcccgagacataggaagaaggttttattttctgaggattagccagatccatgctaatcgcattttgggagaagtagttgtcatgaagaatgctgtctgggtggacggtttccgcttttcctcttactgcttttggcgtggcgtaagtggcgagcctggccgccatctcgcgatcttttcctgtttttaacttgtccggtgctgtcgacatgttgttgcgccaaaaatctccgcctcccggtgcgctcgagccggcttttgaaacattcgccagttcgtttccttcatgcttgcagggggggaaatcagccgcatattttgtattgtcaacctttgcagtcttttcagcttcagtcgataataattctggccgtgcttgcagggagtcgaacatcggcatgattcagttcctaagtgtcttttggggaaaatactttattgagagcatggaggaaaagtattttcaatctgaaatcagacggtttttcaataacttttactctggggcaaatcgcaagcttcagccggcgagtcttacccagctcaaacgggagcagtgtgtttggattgaaatgggttccattcggatgattaaggaacgtgctctggcacacgttcacgcagcgctcagggcgcattgccaggcgaatttctgagggataacgcctatcaccgtgtctgcgctgaatgctcaaggcaaagcagagcagtgccgttcggtgtgtagacgcaatggcaattcagaacacgttgtcgcgctcgcacggcacgcaacgccagggccacaactgtgcgtgcgacttgatctggatgctgcagcagtatgatgccgcggtttagcggtttggggactcgtgcaacatggcaagtcacgagaacgcctctagcccttgctacgtgtaacggcctattggcgaaacttcaggccatgttagtattttagtactgcgcattcgagttgaatgcgcgcattcatggagttcatatgtccctcattactgaataccgcgccaccgaaaacaccattaagcaactgcaaaaaaagcttgaggtattggcggatgacccggccttgctcaccgaaatggagtttgaagagcgtctgcgagcgctgatgggcgagtacagcaaaagcctgcgggacatcatcaagcttctggatcccgatagagcgaccttgacctttgatatcccgagcacgcgcaaacgccgggcggtcaaagtttaccgtcatcctgactcaggtgaggtggtggagaccaaaggtggcaatcacaggctgctcaaggcctggaagcagcagtatggtgtcgagacggttgagagctggctggatcggtaatccgtaccgaccgccttgtctgaaggcctgctgccaacggctcggccattccattgcgcatagttgatccgagctcaatggtctgttgcccttggccgcttgtcgaggcggcacgtatacactgccgatgtcggggcgttttgacgagcaataggccctgccttttcttgcgaaagcggtatccgagactgcgccaaaaaaacgccccctcgctcggcgacggatattcgagctccgatgcatgacgttatgagctggtgggagagaaggactcttcctgcgattcgcaatcagcaaattcgatggcatgttcattggcaatcaggtaggcgcgagccagattgattctcagaacatgcgacgctgcctcgatggctcgaccgcttttggccagtcttcgcaaggtcggcgcgagcttggcccgttccttctgctgttgcttctgacgggccgcactcatcgctgtagagatttttccgctgacgctggtctcaatctgttggatacgattgcccgccgccacagacgcttttatttgttcttccagagcgttcgccacgattgtgcggggatgaaggcttggctcaatgatcacagagggaaggttcctgttgtttcctgcggcgcaccgcaacgcttggttctggatctctgacgccgagatggaggtgctacctcgtgccgcgacgatcagcattgccatgcattacatagtcgcgctgacggtttggctgtaggcaaatactgaaaatgttctcggtttttgcaacgacggctctgttgcggtttgccgtgcgcaatgctcgctttcgcttgaccacccactggcgctacagctgcagccctggtctctgtaagaatgacgctagcgcaagcctgtcgtgcagttcagcattcccctacagaaaaatgcatcacgcaccggcaaggtaggcaggtggacctcacactgagtgtggggcaaggatgtctgctctcaggggtgggtagcagacatccttgccagtatcccatgcaaaggtgatttacccgtacttaacctcatttaagtacgggtttttttgtgatttttgttcgctcgcgtatgacatcgaaccgtccagaccgtgagccgagaggctcgatgtgaccggaataaatcagtaatcgcctgatgccgtgtacgcgttggtagccgggcgttgcattgtgtcatgccccaaagatcagcacgcccgcaaagacaggaacgcagcagatccgttaagtgcaggcccccgagtctggccgatggaggcgcgcgcgttttcgatgctttcgtaacaggcaggcaacacggtcaagcgaggttcaggaatgaggttggtttcagggatcgtcctctaaacggctttacagcttaaccctgaagataaccattgctcaggacattgagaacgcctcgttgtctcgaaattgcattatcggaaaggccgcacattctcacgcccgcggtatcaacatggattccaccgcccatttgcggcagtaccgccaacttgatattttcatccagatacatgccctgaccttgaccagttggttggtccgggagggcaaacccgcagccttccaatatcggcgacctcgatcaagtcggagaagtttgatgccagtggaactttctgagcgccaaaaaatctttaagtctggcggctagagggcctattggcggaattgttttaggcacaacatcgtccttgaaaaggatgaacagataactttcagtggtggctatcgtagtgtgccgttggttttttttcaagacagtttgctgcctgatattggacaagaagacttcagcctgtctgaacttttataaaagttgctttcccaactactccctatggccgccgcgcatgagcgcaatgatttcagactctcgatagtgttccttgagtacctgtcgcaagattgacaaaactccctatgaaacatcaggacacaactcagcgttctgattccgcccaagtcgaaatccttctcaccgacgttcttaccgttgcggataatggcgaacctcatgcccagccgatcaaggcgagcaatctcctccgtgaatccatctactgtcgccttcaatgccctgaacacttcccaggcgctgccggtttcaagcagataatccttctgccggaaaaactttcttcccaagatgctactgagctgaattgttgttcttgggttgtaatgcgctgccgttgcggccatctcaaactccaggcaataaaaaaccgcccgtaggcggctttgttgtgtttcgctacagacaggatcgagcagtttctgcccactttccgcttcccataattgcgctcgacttataaatacgcacccgcgcaccgcttccatcttgctcgatatttgccagtgctgccgcaccaacaaaatccacgttcagcaacaacctatacccggtttcggtttccgttgatgtggtggaggcgttgatctcttgccacttcggcatcaagcacttggcatatttttcaggtgttttcgtcgttgacgcagataactccggcctcccctcctcaagcgatgaaaccgaggagcatccagtcagaagtgccaagatcatcgccccaataagaatccgcatttcaatccctcatccgtaaatcctgactgtagcaccagacatacggatgaggggcactggcaacattcaagccattaggtctttccaaacaagcgccgaatattgcctccgctcggagcggcggagttcattggtcttggaccggaagcgttggccatagccttcttaaatgccgcttctaccacctcttcaccctgagtctctttcaactgctggattagcgccgtgattacgcaatagatagttgaaacatcactcccgtgtgcattaagaacacgctccaaatttctcagttcagctggttgcatttgtgtctctccttggttttggtacgccgataaccccgcatagacggggtgatggcttgagtggacaacttagcgcgtaacgccgccggcgatcaccgcgggaagtccggagcgaagctgatcagccagcctggccagcatctcctgcaccgactctttccagaggatttgctgaaccggcttgccgtcgctgtgtttcttgccggtgtcggtgatgaccgcgaacaacttgccatcaggtgtcacttcccagcgtttcttgccgggtttgtagatcacctgatgttgaagaccgcagtcggcaagcagcttattcatgctcaccgcactcatgccgaacttcgcgccaagctccgtcggcgtgtagttcaactcctgcgactcgtttatcaaccgcttgaccccggccatctccattacatccacgccgattgccgaccggaccatgttgttggcactcaggatggcctgattgccttcgagccccaggctctcggcgatgcgcttggcggcgtcgaagttatcggccgcaacgggcaggcgccgctcaatcggtatcgactcatcgttcgccgccggcggctgcgctcgatggttaaccgcatacccatcattccagtatgcccaaagagcgtcgtcgcactcgttctgatagtcgatgattgtctgccgaatgctctcatcgacctttttcgggttgacgctatacatccaggcaggaagctttttcagcggaaggcataccacctcccttgcttggtcgtccccaggaagctgcgtaaccatatgggtgatgcaggtctcgaaccgatctaccagctttcggtgctgaggctgccaggccatgcccataccttcgacgatgggccgcatgggtacgaatggttcgtcgtgatgctcaacgatgaaaaggttggtgccatgaaacggaacagtcatcagcgcattcatgctgccgccctccgcgcctggttcagcgagcgaagccgaaggttctcggtgacagctgcgagaaactcgaacatctctggcgtcgacaccatgatgtcgccggcgatcattccgctgatcatttcgcgatgggtcattacgcaggcttcccgggagatgggctgcacttgctgatggcctgcatggtccgtgaaaacaaggaagcgctgtgtcggagaaaactgaccaggcaagccattgccctggctgctgtcttttgggagaaactcgccctcaagggcgtaggccgccaggtactcacaagcgacatctagcttgcctgccgggatcagctcggtacgcggaacgttgaaccgtgtatgcagcactgcgtgaagcttatgtttcgcctgccgccggataccggcaggaagctttgcaaccttttgaccgatgaccccgttaatcaggttggtgccgctgacgccgatcacatcatcaatcaaggtggccattttgttactgctgtcggtgtaactgccagttttgcggatggcaggaagaacctcgccggcgagccacatctgaaacggcagggcctttggcttatcggaacggccaatgaagaaatacaagccctgctcggaaagcatcaggacttgctggcttccgccaagggtgtgaatcggattcacccccttccattgcgccggcacatgatcgactagccgagctgggttgctggactttgcatactccagtgaagcaatcacgtccttggcaacgaaccaaggctgatcgtcgatcagcagcgtgcgcacctctttcgtctcgaagcggaaagggatgacattattagcctctgtgctaatattcgacatgacgttgttttcccgatagttaactgcgttggattcaaaggccctggtcgttggcgcgactggggtttttttatgcctgctgtttttcatgctccatctcctgctccagggattttctcaagcggaaaacgatttcgccgctgaggctgcggccgttttcagctgctctcatctcaagcttctctcgcatttcgtacagcatccgcaccgcggtagtaattttcagagctttcatagtgcctccttgtttgcgttttgtgagtttaatgccttttgtgacttcgtcaaacaatttttgctttttgtgcgtttgctgtacgcttctagagatatacaagggggttaacatgtcgactgattttgccaatcggctcatctcacttcgaggtgaaaaaaatcttacgcagcaacaacttgcggacgctgtgggcattaccccgtcacagatatctcgctacgaatctggccaagctaagccgagaagaaccattctcttcaagctggccacagccctcggtgtaaccgtcgcagaactgagcccggatcaaatccttcaagttgtcgtaggagagcgagaaacaaacggtccgccattcaaactccagcaacgtatgctggatgagctggcagcgatggatggagaggaaatccgaaagataagggcagaagctgaagaagccggcattccgtttgaaaagtacatcacagaccaagctgaaaaaaacttcatagaaatggccagacgagctacagaatctggcgatattgctacggccgggttttacaacgtctttgcacgcatcttgtttggaaccaacattaagcttgtagaccccaaggaatagttcacccattcagttgtcatgatcatcgtgataactgagcagccccgcccgggcttttctcgccagcatgaaccgcacccatcaaccatggtcatcatgaccatgcaggcattgaatgaatccgctctatcaactccgctcattcaatcatcaccataatggtgacgacctatgttaaagatgggtcgtcagggtattgccagtgccaacaccttcacgccaaagcccggccgagcgccgggctcctacccgattgaaaaaccaaggaagaaccatgcgaaagctgcgaagtcatgaagtgattggtctgagcgttgatgaaattctcaaagagttcaacgagcgagcctcggagttcggcgtcactgaggagaacctggtatcggttagcgtgaatccaccacgtcacgcgatcaagattctcgatggagacaaaaccaaagaagccaaggtgcagatcaccttcatctactggagtgatcgataacctccacgccaagcccggccctgcccgggctttttcattttcagcaaggagcgttgaatgcgtatttcagatccgagagcccacaaggacaatctcaaaatcatgctccagggcgtccaggaacaggagaacgcctactgggctcagatggctgggaaccgtatgagcgctgccccttattgctttgagcgggcggcgatactgctgcgaaagcaaggcgaatatgatcgcgagattgagatatgcaagcgctggataggcatcatggacgactaccaaggccagcttatagtcaaagcgggaagagcctcgttgactcacaaagggccgacctccttagccatcgtggctcgcctctcggtggcggaaggactggcgaaaaacccaccaagggccccatcgaaagccaaatcagctaagtcaaagccctccctcaaggcagctacccttccgccgcttactggcaagatcactggaaaccatccgtgcgatttcgaagttgtcggagaatcccactatcagcctgcccttcgaaaattacgaaacagtcgccacatggctaccgacaatgacttcgtcgcagacatagtcgccgagcccgagaaccctcatgacccaaatgcatgcgctgtctatatcgagggcatgaaggtcggatatctacctcgcgacgcggccgcggactttcatcagcaagtcgccgccatgggcgtcactggaatctggaggttccagactaaagccaagctatccggaggctggggagatcgacccatggtcggagtgttactaagcctgccgaagccctagccagaaacgaaaaagcccagcgcggggctgggcttcttcgatggatcaatcctgcttgggagcaggtgcaggcggaggagccttgggtggcgctgaaggaagcacactcctccctgtacgaatccccagtagcgccccgcgtcaattcggtagtagtttttggctctcatccagccaaggagcggctatgtctattagaagcctcgcgaagaatcttcctgctgaccctgacaactttggctcagtccttggctggggcgtggtcgagaaatcaccttggaggttcattggtatttacgcctccaaagatgcagcggaggccgaagccaaggcccgcggcccacgcttcggcgtcgagtacggatctcaccgactcggcacgaacgactttatcggcggatctacgcctccaaagtagcatgcagggtttcctcggcaagctggatatggcatgggccagtaacaagcttggcggtcaagccaggcttgccagtgaagctccggcgatagcctggcccgcctggtccgactttgcctgagaacttcatgcggttgatctcaatcccatcatccaagattgcgacctcggcttcagcaccgcagagaacgccaccggtaatggtgaataggtcgtgaatggtcagcatgtagcgctggcttggctgcatacagccctcctgctgccagataggcagtgagaaaatgaactgaaggacttcccagtcctttgcctgcaagcccaaggactgggattgcgccaatttcggcgcgtttatgacctggaggtcaaatgaagactgtagaccaacgccttcacgagcttgagcaagcggtaaacactattccatccgcaattctcaacatgttgatggcggttgtttcatcgctaaataaacttgagtctttagataaagaagcgctgagaaatgaacttgaggacctaaaatccgtacagatacgcaacggaaatcaagtccagtacgtggaattaattgaccatgtcttggcacgcctatcctaagcgctatgccgacagcgcttgagtagctgccagccccattccaaatccagcagcataaagcaggccgctgcgctcgcatttcttcatgacgacgtgccagcggcccgccaagttctgcttggaaacatcggtccgcccattctcctggacggcatcgcttgtacttccagcatctttaatttgcttcatatccttctcccccggccctgccgcatcatgtggttgattgtgcatctttgtgcctgaggatcaggcgcgttcgatcgagccagggcccgccgaaaacgatgatttcgcttggccggccatacaggtggtgcagcaggaaaggcccagggccgaacacctcggctgactcctcgggcagctccggatcggcgccaaggtagatcccggcgtggttcgggtgcgccgtgcggcctacggccatgacaatcatgtcgccgcggcgcggctggtcgacccgcataaatcctgccgcctcataggcctgctcgtagaggctcggaccggccgggtcttcccaccagccatcagctcgctggaaggattcgaactccagcccccactcccgcttgtaccagtccgcgcaaacctgccagcagtcccaggcaccgtgaacgaatggtcgcttgagcaacggcgtgttgcccgccggcgcgatggtgcgcagatccccttcgggccagctcagaatgtgccagggcaacgccgtggcctcgcacatggccaggtcgcgcggcgacggccggctggtggcgtctgggtgcgaatgcacgatgccgatcacctcgccctggtcctcggccgcggcgtagtcctccggatccagtcggaactcctcgtttggctccgtggagaggttgcggcacgggaagtactgctgcttgcgcccaatggccagcagcagcccgcagcactctttcgggtactcggccgccgcgtgtgcctggatcgcgctcaggatgtgtttgcgcatggtcagctccgggcaatgatggaaacagcggggaaaccaccgaaaggcagctcgttgccctcgccgaagcgcggaatgcatccccggcccagggtggcgtcgcattcgtccctttccgggtcgtccgtgggcaatccgtccttgtcgacgtagccgccggtgtaaccgcagttcggcccgcggtagccgccggttaggcaccagtggcaaagcgtggtcgcctgccggccgatggactcaccacccacgtcgccggggctggccagctcccagctgaccgtttccccgtcttcgttggccttctgatcgatgtaccagacctcgatcgtttcctgggtgggatcagccgttgggttgccgcttgggaagttctgcgcatccaggtagctgcccagcgtgtgccgcatggtcagcttgaactcgagcaggtcgtcgaaggccaggcacaaggcagtgatgcgaccattgacgttgccgaccgacagtgtgggccgtaccgcggtgccgtcgccgttggcctcgatgccgtcgatctgcatgggccaggcgccgtactcgttgccctgccaccagatggattttgccggcagttggtcggcgtttggccctgctgccagcagctcctcgggcgagtgtgggatagcgtgcccgtggaagcgcaacacatccgccccgtagtccgatccgtccagttcgaagagcagcacttcactgccaggctcaagagcctggatgtcactgatcagcggcatgattgccccttatggatgaaaggcccggttgaacgtggccgtgaccttgaagaccccgcccccgacaggagtgggaacgggattgacgcaggtgaacagacccagctcaccgagcggagtagtccagaggaaagccttcgcgccggcgtgccgatcgtagaaggccatgatctcaagagctcgggccttcgaaccggtgtaggtgaccgggtaggagtcttccttgttgttcggtccgtcgccggcggtttgcttatagccgtcaccgaactgcgcggttcgcacccgataggtgatctcgggtgcgtccccgttctgcgttggccaggtgaacgtttcaatcgccattaacccctcccatttatcacgcgccaaatcgaaccacctggctgcagccctctggcgattgccgtttcagcctcaacctttgcagcctgctgaatgcctttgcccagctgcgtcgtgtcctcctgggtggttccttcacccgcgcccgatgtttgcaccgagacggctaccgggaagttgtaggtgttgccacctccgccaccgcccatggccatgacgcccaacttgccgctggaggtcctggctaaaggcatgattgcctcttccccagcctcgcccataaccccggtcttgccgttggccatcccgaacgccgtgggtttgctgacaatggagttcgtgaaggcgccgccgtcggcgaacatctgcacaccagccgaccaggcgccacccttggcctgagggaagtagtcgcttgtgtacccggcctgcgtactacccagcgaggttgacccagtaccgctaccggcgaagtaattcactccggcaccgacaagactgctcagcaacgcagagctggcctggcgggtcgcgattcgcgccatatccaccagcaccgacttggtgaagtcggaaaacgagccctttccggtcaccgcgaagttgacgaccgagtcctccatggagctgaaggcgttggtgaacaagcttttcgtctggccagcaatgtcgcgagccgactccaggtagttctgccaggccgatgtagcgccggcgctccagctaccctgggcagcggtcatctcgtcgtagttggcgatcgccgcttcctgcaggtcccgctgcgtcttgtccaggactgccagcttctggttgtactcgtcgaggctcatgccacgggagccatcgccatactggtcggccaaggtcagacgctgctggttgatgcggtcgtcgatgccgttttgctggtcggtcagcccgcgctgccggtcaccctgcccaaggcccgcggccgcacgctgcccctgccggcgcaaagtgtcgacttgctgctgcagggctccggtataggtgctgacagcctgggtctgcttcttgagtctgccctcctcgttcgaggccagtacagcgagttccgagtcggcatccttttgcgccttgaccatcgctgcgcgcgcgtcggcgatcttctggtccagctggatgcgctgggccgccgaggtgccggcctttcccttggtcgcttcgagcgccgagatctccgcctcgtaagccgcggtgacctcgtcgcgttcgttgccgatcatggcctgacgcttgagcaggtaatccgcctgggagaccaggccggccttctgcgcagcttccagttccttctgggcgttcttgtactcggacaggatgccggtgagggcgtttttcgagttgttgaagctggtcaggtcaacggcgcctgcgggtgttttcgagtccttgaacttgtcgttgatattcgcgatgttcttgtcgaccaccgcctgattcaggcgtgcatcgttggggctgactttgcggatatcgtcgagctgccgcttgtactccttcagtgcgtcggcgcgcttctgctcgttcgtccaggaggacttggtcagggcatcgaccttacccatcgcggtgacagcatcctgctgggctttagcctgctcaccttcccacttggcaatgtccgccgccgcggccttctgatcctccagcatattgagctggttgctgtagagctcgaccatctccttctggttctggaacgctccaacatttccggactgagcctgctccaggttccgccgggcctgctcgatatcagcgtcgatatctggtcgccccaggttcttcaggttgtccgctgcccgtgctactgcgttgtagcccttctcccagaagctcagattttcgaggatccgcggcgtgcgctcgttgatcgcgtcggcgtattgctcggtcgccagctttaccgcaccggcatgatcaccctgctcttcaagggcggcgatctgcgaataaaccgaggcagtcagatagtggtactgctcgttgagcgctgccgacgcctttaccggctcgtcagcgatcttcgcaaactcagcgaccgtatccttgaccgccttgccggtagcttcctgcatcgacacggcagcctgggtgatacccaggaagctctcacccgcgattttgccgttaccagccagcagcgccagcacttcagcagcctgtccggtagtgccgacggttgcgccgacttggcgcgccatatcgccaagctgcccagcgctcaccccggcatagttgccggtcccaatcagcgattcgttgtactcatcctgctctttggtgcccttgtaatagctgaatccgagagcagtgactgcagcagtgaccagtgcgataggcgccagaatagcgagaagccccgctgccgacgcgccagcaccagcgcccaactgagccacggcgcgaacaccgctgccccagtcaccggacgaaagcgcgttgccgagttgcacgacgttttcctgagcctggcgggtgccgaggcgcagcttgtcgaagccggaggcagtcttctcgagcttggcgtagtccttgtcgatcttgctcaacgcggagttgtactgctcctggctgatacggccagcatccaggtgcttgcccaggtcctcgatctgcttgtcgagcttggccaccgccgtcatggtcgggttgatggcccccagcaggctgttgagagccttctgttcgtccagggtggacttgaccaacgcggcctgctgcttgtcgagttgcgcagtgatcttcgcaaactcggcctcgccataggcgccggtcttggtcagtttcgccagcgcgtcacgctgctttgcgaggtcctgcgtcgtcttggcgctggtagaaagtgacttctccaacgcctgcatttcgttcatcaggctgacggcggactgttcggcccggccgccggcctttgccatatcgtccaggctggttttggcttggattgcatcgcccgagtcgatcttgacgccgagttcggcgatgttcataaataaacccctaaaaaacaaaagcccgctttcgcgggctttgtagattgcaatcggctaactaattaagtgtttttagcgctttcaacgattctgtaacctgcctagctacgtcgttggaggagtctagggattgagatcttatgaaggctcgattagccgactctcctgctttttttgcctcttcgggacttgcctttgtttgggatactgccgtttcagttgcgacccctacgatttcagctttctgttcaatggtcgcgttaggaggagtgacctgttttatgacctcgcccactaccttcgctttatcggcactacccgtagccttctgagtttccaacgatccaattgctgcagcttgtgccgtggtggcaatggcagctcccgcactggcggtggcagagcctcctttatcatctccagttgcggttgacgaagcagatgctggtacagaagcaagctttttctcgtcgggcccgatgttacctcgagtaagctgaatttcttgcgctatcagcggcgctgcaatgcttccagccttaacaattgcatccatgtattgagccggggtaatagccagatcatttgcatacgccatgcagaatcctgacgccatcgcctcgtacaacatcaccccctgagttttctgagatacgttcgcaacagtttttgccgcgctttctgcaaatttgttgcttgcctgagggttgctcggggcatcctttaacgccacagccaaactattactcaaggacgcactaatattctctgccactcctgccggaggttctccacaagtacgttttgttgaactattaacgatgaaaattctgcgatccgacgtagtcgcaatagtggtaaaaaaagaaccatctttaacttctgtaactatcgctggatcagtcattctcttggtgttgcaagcactgagcaatacaagacatagcagcagtaaacctttcatggcgtcctaccttcttcattcctgagttctactcactgagagaatagctggcattttgccaacatcacgaatccctagcgaaattcctgctaagagaaatccatttgctactgagtaaatgctcgcatcacttggagggcctctgcctccatcacgcggatatcttcaaatacgcgctgccactccttggtagccactccgacaagccgcatcacgcccggcaaaacgccataatcgagaccagttgcgccgccgacacccacgcgccactgcgtccacatcgaatccatgacgaggaaagacagccagttgtctggccatatctcgaaaatttcgtcgtagtcttcaggggaaaagccgaatagagccatttgctcaggatcagcatctgactcatacagggcacgtgcggcggctgtcagtttcccaggcgggctttcccgaaggcatcgctataagctttcacaactgcgtcagagacaccgacgcagctcttcacaagtgcggtgatggattcatcgctgagcttgtcgccaaacccccagccaacaaccaagtcttttacctgctcgacgccctgctcaacttctacagcagtaatctccgagagcgtcggctccgtgcccttgaagcgctcaccaatggcctcggcccgatccttccaggagtcgaacagctcggccaaagccgtgcgatcacggtatttgaacgtaaatggaaccatcgccggcttatcgccaacttgagggatagcgacgtcgacggtgaacgtaggcttcggcgcgatggaaaactttgccatgaggcctccttaggcgttgtaacgggttgggcgggaggcgaacgacaaagtgatggtccgcgtcatgatgttgttgcggctcagcgttggagtcgcggtgatcgacacataggcgtagtagtagatcgtcgccccgccgggcagattggctcggaccaggcgcggttctttgtcttcgtccgccgcctcaacgatggcgacatacgccttctccggatcgtcggccacaggaagagtcatgctgctagcggatttggtggtgggcatttgacgatcatcatcgtcttccaggaacccgtaggtcaggaattgctggtccccaccgttagccgccggctcggtgacctgagagatctgtgtccagccagaagcggaccggaccgtgcccgcccccgatcctgctggatagttcttggtgctggtggtgtccacgccctctgccgcgaagtcgcctacatcggaatcgataactcgtgccgggcgaccattcagcttggcccaggccgactcaatgacgatcacgtcgccattggccaggccgtgcgcggcggcggttaaaactgcgggctttgcattggtgatcgcagtaaatgccttcggggcgctcatggtgcccgcaatttcgaaagtcgttccgttgggaatcctgacgctcatggtttttcctctttgcaaaaatgacaaaacccgctcgatggcgggttccggggttgcccaacgggcgaattagttggtatcggcccggtactggaacgatgccggcatggtgaaggtgctgccgtccgggatgcctgggcctggcgctactggagtcatcaccagggcgaccaggccggcacgcggaatacgcaagttcagcgggaacagcgcggccagttcgtcgacaatgccgctcgcctcggtccggtacttcccggatggggccacgatgttgacctggaacacgccggtgtacagccggtggtctccgctcagcgtgttgctggccgtgtccgctggaagcgtgaaagcacgcaggtaggtctcgccagcggccggggtgtaagtctcgttctcgaccaccactttcagcggcttggatcgagccttggcccaggccaacaggcgcgactcgaaggccgcggcgatgatgttgtggctcatacctggttgttcctgatggcttcgaggacgatctgctggaagcgagcctgggtaatgcgcaccatcccgcctggagcttggtcggagtagccatactccagcgggaccgcatacggcaggttgttcacgatgaaggccgtggctccggcccggaactcaatggagtcgccaacaaggcgcgccgtcgtctccgttccggaggggtcgatcacatcaagcgtgccgccggcaggtgccgctatgctgaactgccagttgccacggaaccgaccggtatcaaccggagacatgcggattaacgacccgccaagctcgatgatgatctcgcgtaggcttgcatcgaccgcttctttcgcctgagcagcaaattcggcgagctgcagctcaaagctgccactcttgccgccatagcactcagtcatgtgcgatccgcgcgacatggctatttcctcagttgcacagtccaagtggcaccggccgggtcctggctgacgttcatggcgcgtttatcgccaatgacatcaccgatttcagggacggccaatgttgcggtgggagcctccagcagcgtgatgaagagctcgttctgcaggatggtgagcttttcgtctgctgtttgaatgagcgtcccgtcgatctctgcgcttcggtatttcccgaaaaccccgcgcccagcgtaggtggttatggtctcgccaggcgtaggcgaatcagggtcgtactcgccttgggtcgtccggacacccgctaccggtttaacggcgtccgccaggtccgtatcgaacgcttcggccagatccctctgtaagtcatcacgtagccccatatcagcacctcacgactttgacctggcccgtgccgagataaccggcgagcaacgcaagggcgaacgactcgccagcgctgatggtgcgggatgactcggaaaatgacttgctgctcgacacgccatcggcggatacggacttttcagtcacgcccgtttccttcgatccgtagatccggccggcggccgcctccctggccacctccgcccccgcctggacaacatcgtccgggaccgggtcgaaaactggcaggccgagattggttagccaggtgttggccatcagcaccgcgcgcggcttcttgtcgtccggtgcccaggtcgaacccagcagtgcgtccacctgctcgatgctgatgtaggtggtcattacgcggcaccatccagcagcttctgcaggtcttccaagctggcttcaggttcgaactgaatgcccttttcggtcagcgcgtccttcagcttggctttcagctcttcggcggcgttaacctcgtcgagcagcttttgcagatcgggcttcttggctttggggtcgaacgtgatgttcttggcggtcaatgctgcgcgcaggtcatcaatacccggcgccttgaccttgccggagccctcttccgcggccgagccatcttggcgcagtgaaaccgactgccaggaacagccctccggctcggcgatcacctcgcagttgtccgcgtaggcttgcggcaccataccggtgactgcatcgcattcctctaggccagcaccctcgctgtaggccagcgggtttcggatggtcaggcctttggacttggccaactccttcagttccggggtggtagcgcccggaacgaaccacagaatctttttcttgctcatgatcacctcggcggcgccgagcgagcccggcgcctatcagggttagagtgtcttgatcaggacgccagcggtgtccttgttcgaggtggccaccttgtcccagttggcggaggtgccgatggccgcgtcggttggagacttgccgccagcagcggtatcccaggcgtagcccttcaggccaacgttgtaggtccactcagcctggtaggtggtcttgatattttcgccacccacggtgtcctgcagcaccgcatggaaatcgccgttcggctgcacaatgccagccccctcaaccaggcccagggtgttataggtcggggtttcaccggcattcaccagggcgtcggagtcggtgactacgaacaggcgaccgaacgcatcgcgcatgacgttcacggtaccgaagctgaacagttgctcggcgttggtcagggcgttgtcgtacagcgagtgcagcgtggtcgagtgcagcacccaggcccgcaatgctccggcacgatcaccgaacttacctgagcccttgttcagtactcgaaaggtcggcgccgcggccgaaccatcgtgcaccaccgcggcgttgccggaggtagcggcaaccaaggcccggataccagcattcagctggtcctgcacctgggccacagccaattgctcgccgatcttgattgcggccagttccgggttctggagaatccaggtgtactgctgcttctcgaattcaatcggcggggtgccggcggcaaccttcatcgacacattgagcaggtgctccaggcgcttggctgcgacggtaccggtgccataggcgttgcggcgacgcaccaggccggcgatctgcttgaacgacgcctccatggagaaatcgccctggttctggccggcggtcagcaccagagtgccaccggatgcctcgttgaaggcgttgacctgctggtccacgacctcggtcatggcggcataggtctgtttgttgaatacctgaagatcgaatggcatatgggcctctcagtgatcgatcaagcccgcgactgtgcccacgccacacgttcggcgtcggtcttgcagtcggagagcttcttgtgggtttgggtgttgccaccaccgccgtgcggagccccgccgccattggcgccggaactcttcaggatgtggtcgcgatgggggtattgagtgacgagggtttccagcgcttcgttggagtcggccagctcacctgggcgggaacggctgaagatcttctgaccctgggcgtcataagcgacgaccttgccttcctcgatcttgaagctgttgccgaaggtggcctggaccatgtcggccggaaccgccagcttctcggcgatgaactgggagcgggcgaaactgccgccgatcttctcggcatacaactgctgctcgaaggtctgcgccttgccgttggcttcgtccagctgactttggaaggccttgctgatctcgcctttcaccttctcgatctcgccagcatccaccagcttctttgcgtcgaggttggcgacggtttccagggctttcttggctgcagcggggtcctcgattccctcaaaggccttggcgaccttctcgagcccatcagcgcgctcgcaatgagacttggcctcagcgttcaggcgggtgatagtgctgcgagtccccacggcgtcgaaggcgacttcttttccatcatcctcgacatacacgggcttgccatcctgggtctcagcgtactgcttgccatccacttcaacagtcttcagtttcatttcgtctctctgggccatccggccagttaatgagccatccggctccttgtcgccccgtccgtccgaaccgcaggcaaaaaaaggttcttcacggattaccgggaaagacgctcttgatcttcatgaaaaagaattcgctgtcccggtaaccgtacgccatccgcttgatgaccttgattcgattgttgatgccttccaactggcccgtatgcattggccagcgcacccggctgacgatgccccgccagtaacccttcagtcgtttggcaaactggatcagaggcggtatgtcgctttcatgcgcatggcgcagccattgtcgccaggctgatcgccagccccaggcggtgctcggtgtccaaagcgttttgagttcagccttcatcaaatagaccgtcatcaacgcttggttggccgccagcagatcctccaggcggacttgttgttccggcgttttcaggttctgccgattgcgcagcaacagccatcgcgcctgcttgatgaccgtgcgggcaggcttgtcgtgacgtagccgattcgcttcatcgacgcggactcgatcaatcacctctcgaccatacttggccaccacatggaagaggtcgtagaccacgcgcgcttttgggcagtgctgacgaacctccaggtcaaaggcagtgttcatgtccatcgccaccgcttcgatgcgagcgcaaccctctgaccccagctcttcgaaaaagggtctgactgccgcccggctgcggccttcgccaatccacagcactcgccgggtatcggcgtccagcactacgctggcgtaacgatgacctttgaacagggcaaattcgtccatgaccaagcgctgtggctgcgcctttggcaaaacactcaatgccgcttgcaaggcgcgacgttccagcaagcgaacgctgtcccaatgcaacccgaacagttgggccacgtgtagcgtgggaaggcgctcgcaggcctgaatgaccgcatcggccaggcggcgcgtcatgcgggcatagcgatccagccaactgacggcctccatgcgtttgccacagtcccgacagccgacacgccgaagcaaaacgctgaggcgcactgctcggccaagaatgggcagatcgcggatgactcgctggcagtactcatgcgtggttgaacagagtttttggcagccgccacaggaagggaatcgggtggcgtggggaatcagatcgatctggagcgcgtcaccatcaggcttgatcgtgacgacagaaaagccctcccaaaagggaaggaaagtattaatatcacgcataagaacgccggtttgttagatgtgtttgctcgcacgaacatcatcaatcaaatcggcgttcttgtttctgtgtttcccgggattccgtgaagaaccaaaaaaaagccccgcacatggcgaggctcaagttggtaaatcctagctatcggctcatggccctcgctcagatggtgtgtttaccgttcagatgccgattgacggtcggctggcttttaccagtgactttctcgatctgttttgtagacatcccctgctcagccatggcttggcatgcagtgtcacgctgttgcatagttagcgactcaaagatcgccttgttgaacttcgactggcttgactcaatcgccttcatgcccgaatcgattgcttgtccgatgctattcagcatctgtttctttacgtcttcaattacatcattaaccattgtgaatcacctgctgtacggcaaaatcgccatgaatagattaggcctctctttctattcactacaagcccgattcttcggctatatacgcccccttagctcgtcaagcttcaggagcttgcccttgtcgttgtagaagtcatccagcttgagcttgtcctgtcgcagcagcttcccgcgctcagggcccaggatctcgtcctggcgcgccgccgactgccgtcccagccattgggcgtaagtcgttgactgcggtacctggccgtccatggaggcccgcgtggcgccatcactgaagccaagtttcgatgcgcttttgaggatcggcagcttggtcgaacggcagcaccagtggattcgcccagggccagccaaccaggggatcttgtgcccgatcggtaagtaggtccccagcgtatagggcagccgatccctgatgcggcaggtggtcgaggtgcgcgtatccaaggtgctcatccactcaacgtggctgatgatgtcgctgttcgcctcataggccttgtcgcttgcagcctctgcggtgctcgaaatggcagaccggacaacggcctcgatctcccggcgcgacttctgcaggatgccgtcggcgtacttctccgcccgggtacccatgatgttgcggacgatttcagcagtcgtgcgcccctcaacaacgccggcgcggacggcatcgcgaacggcggcagcgcggttcgccttgatgccggccatccactccctgagcaagcgcccctggaacggcctggcctgtgcgagcgccttaacctggctgaactgcgcggcagcgatcggtaaagcctcctgcacaacggcagggataacagcctgcagagcgccttgctggaaggcgatctcgtagctgatcaagccgtccgtggcctgatccagcgcttggcggatctccacgaaagtggactgattcaggcgcaggacagcggacagagcaacatccaccgaaggcgcagaccggttggtgccaagactgtcgatcgcctcgatcaacgcagcacgcaggtcggcgtccttgctgttcaggatcttgatgattgctacgacctgggcattgctcaggtgtgacaggtcaacctcgtgcccgatcagtttgtccagcagcttctcattggcggtcttcatcacagcgtaccgagggcaggaccctgagtttcgatcctcgccagctccttggcccagtcatattcatcactgataacgccgcggcgctgcatctcggcgaacagcgtctctttggacagcatgtcggcattggccatcgccaccagggtgggcagcgaaacctctggcatatagtcgacgtcgaagtttccacgcatctcgaccgcgccaccatcgccaaggccgcgatagtcagccatgaactggagcagctgggccaggcagtcaccgaagtggcttgccattcgagccagcggggaaagctcttgcgccgcctcttcctctgcctgtgtggccgtcttggtggagctcttttccggcgtgagcagcttgcctccagccatgtgcatctcaccgagcagatcctgcagagcttcacggccagcctttaccgcggcccccgtgtgctctacatacttaagatcaccatccttcggcaggtcagtcagcgcaccagttcccaccttgaattcggatggaacaggcttgccctggttatcgaacgtggcctgcacgccgatacgcaccaggatcggaacgcggatgacatgaaggatattgtcctggtcgctttggctctgccagtgcttgacgttgaggtgggccagttccagtagcggcggcttggcagtcatgaagccagtccgcccggtgtagaacgtcacccaggggacgctggccaggctgttggtgcccccggcatgcagcacccattctccacccttctcggcgcgacggtaggtccgccatttacctggctccagcacgcggatctgctcgacgcacttggcaccgaagtcgccatcctcctcctcgataacttcgatgtagcggatcatggtgagcatgccgcccttggagcgccatcccagaacctgccctggcttcaccaggacaacgtagggccgcacaccggctgcctgctcctctgcctgggtgcggacacccttggcaggaggatgatcaacgaatgcatggcacaggccatgactcaggccttcccggaagaactccaccgaccaagagttgaggtcattgccggcgaagtcgatgtccttggtcattacctggatggcctcaggcacatcgtcaccgacctgcagcggctcggcaaaaacccgagaggtcatgttgccgaccgtctccgaataagctggaagtagcgtggaaaggcgaagccgctctttgtacgagtcctcatcctccgcagggtactgaggcagcaaggtctttcctgccgagcgcatagccatcgtgccgcccatgagcggagttatcacggcccagtaggcgcgcatggcgtcgacagctggcagcgtgatacctgggttatcgctcatggttacattctcagtggttgggttgcggacaggtcgacgttgattgggaatcgcttggcgatgaagtagccggcggcgtcgttcatgtggtcgtggccctttttcgggtccttgtcgggatcgccatgcttgtcataggtctgccgctcgaggcagagggtcagctgcgggcactggtcgatgttgaccttcaaccggcgctcgccgtaagtgttcaggagcatggcgttgaccgagttcacccggtctttgacgctcgggttctggctgtccacgatcaccgtgaatccggctttccgcagaagggacaggtccgattcactagcgttcttgctgctggtgttctgaccgctggcgtccggataaaccgcaacgccgtggccagggaagcgcgccttgatcttctcgatcatctctggcgtgtcacgcaccgaatggaactcgtccagggccagcggaagcccctcgcgaacgacgtagaccaccgcagccatcttcatgacgttgaagtccattcctatgtgcagggcctcgccaggcttgatgcggtcgctggtacggctctcgctgcggctgaaggtgtagtagacgacgccggcatagttctcgaagctggcctcgtactcctgccggaacgtcctggggtccatcttgcgacgcgcggcgtccagctcctcagccgggacgttgccgccctgcagcgacgtgtatagccagctcttgtggtcaggctcgccgccggactggccatctcggtaggtgtcgaagcagtggttgaagccctttggggtgccgatgcgcagcgcgtggccacccttgcacttacctacgcccggaacgatgtactcacacgtcgacagcatcggtcgcaggacctcctcccaggccgcccacttgcagtccgcccattcgtccaccagcacgaagaacaggccggaaccacgcaggtcgtcgtagttctccagacctacacagcggatcaggtgcccgctcttgagcgtgatcagcatgtccgactcattcggcttgcactcacgccactctcgcgggatggcctgcttcagccggcgccagaacacccggcgggcctgtttctgggtcggggccgcataccagatctcgtcctcgacgctaacaccccactctgcagccagccgggccgcacggcgcatctctgctttgccgaggaaggtcttgccgaatcggcgaccacaaaccgcgtcacggaagcgtgcattccgctggtaaccccagacgtagatgtttgcctgcttcggcgtcagctttactggggcctcataggtacggggtagcggggacattttcatctggctccagggtgtactcagcaactgcgtgctgctggtccgcctgggagcccaggggtttctccggctcgaggcggcgattcacgtagacatcgccgacttccttcgcggcctgctccaggatctgcatagccaagacgatgttcttcatcccctcggcgcgctccacaaagcggttcattgctctcagacggaacgcgcggttggcgatcgggatttctgccgtgtcctcacggaagcgcttacgggtgtcgtggaacagggtctgccatttggtggcgagccccttacccgcggccttggttgggtcgtgtgtctccacctgctggcgggtaacccccccccaaattcgttcttgacggagtcgaccacctgagaaggtgtgtcaaaacacgccagagcctgaacgatgaagctcttcacctcatttttcagggttgccatagggtctcatccgtctagagcctgtctagaatcaggccgacttgagcagacaggttccgcaggccctcgatatgttcaatttccccacctcagcgggcttgttggcggcatctaccaatgcctggacgtcagggctcgcaccgtagcggcggaccacgccgacgaactcctcgacgtcatggccacgcatctcgatcttgggtgcgccttccttggtgaaggctggctgaccgtacttatccttggcgtgggccaggtgataaagctcgtgctccaccagggcgcagaactcttcatcgctgcactcggcgcagtagtcagcagccagggtgatgatgaaggccggcacatcgccgaaccagtcacgcatctgctgctccattcgggccttctgccagccgccggcgcggaacgccacttgctcggcctggcccaggactgtgcgaccctgcttactgaagctcgacgatgcccacatgacccggatgtctgcatccagtaggtgagcgtgatcttcgttatggatgctgccggtgtcggcaaggatctcggcttgcagccattcccacacttcaggcgcgggagtcaggcggattccaaagtcggaaagctcggccagatcaaccagtgaagatggagggtatggcctatccatggatcaccttgaacttgaaatagtgacgcgctgccggtattggtaatgattcaccaatcaagcacagggaagaagcaatggagccgagatacaaggtaaagcgccgaatctccgttgaaatcggcggagcaaaaggcggcctaaggacatccacatcctcaccgccaggcttctccgtgtacgacacgctggaaaagaagaatcttccagagttctactcctcgcatgcggacgctgaggcccatcgagatcgcttaaacaaggatcaaaaaatgttaaaactcacagatagcaaccgagcctttctgaacgagatccgcgccctgaatgccgacgaacatggccgagaaatctttgtaggccttacacgcgaggagtctgaacgctaccttgcgctgagtgaggcggataaagatctgtccacaaaagaaagggacgaatacataaagcttgatgaacagtacaaccgcgctcgaatgcaggttattggagcagagcatttgttgcggactgagaacccaccaatccactgattaacaggacggcggcgagatcagctcccgtcgccgtcaagcagcacatcgatcagcttctgctcacccaggcgcatggcgcccaagcactgcaggtcatcacacttcggccccagcccaaacaccgtcacttcgcctttcggccccatgagggtcaacgcgccgacagcacattccggatgcacaccggcatcgaggtcatctgcaatcttgcgcagggtcttcgcggcgtcgcgccagccctcgcgcttgaactcaacgagctttgcggtcatgcagtcaccccctggagccactcttcaatgatccggcgcactactggctcagtcaggatggctgagggcttatcgccggcgatcactgagcgcaccagctcacaaggcagcacgtggacaccgtcatcggccgttaccgtcaaatgcggccgctgatcggcgatgtcgtggacctctgcgctcatcagctcaccatgatgtgggtttgtgcatgggcatgcccatgcagctcggcgacgatcaggccctggggcaggccagcagccttggcagcatctaccgccttggcgatcgcgttatccagatcaatgagagccgtattgatttcagggcccagcgacagggcgtggtgcaatcgaactacagtgcccgcgttagagctcggcgttttcgcgacgcatcgctcacaccgaccgcacgcggtacccaacgcaaaatcgcccttgcaaaccggtttcgtgcaaccattgttcatgcttttctcctttgccgcgtgtcgcgacacgatttgattgattcgcgcaacgtgtcgcgacttacgctgcaagctgtagctgcctgttgaacaactcgcggatctcgccaagcctggccatcaccagcggctcgcccttcaggtggatcaggtggaccagctggtggacgatcccctcatccgacagaaccacgctcgatggcagctctttaaaccagcaaacgaacaccgcgaagtgcagcgccgcgggcagctccttcaggaagcgcttgtcggtcatcccgacgaatcgggcatgttcctcgcgcaggtcctggtagctggccgagtactcgcggccaccgatgacgtagtccatcacccggcctcgtccactttccgttcagcccagcgcctgccgagctggcgggcctgctcaacgcccaggacgccgatgaagcccgcggtggcaaacgaccaggcgatactgaagccgaactctttaacggtcagccccaccaccatgacgatcagcgcgccaagcgacgcctcgatcaactggcgtactggtttggtctccttgccgtcgtactgaatgcgcaaccaggtgagcgcaaacgttagccccatggcgaggccgttttcgcgcagggcggtcaggaccaacacccagaacgaagggtctttttctggcatgttcggcatctcgatatcctcccggtagggagttgagggattaaaaaggcctgcgttggcccgggcattgcccaaaacgaaaaagccccggcgaatgccgaggccctgaataggtgcggatggcaggtgctgatctcctgctttcgggttggtcgagttgcacgaccgtacagtgtggctccgatttccacagggccgaagcccgttacctttacgcatcagcctgcgcattcatccgcatagcgcgagggtctttcccctcctgtccgccgaaggctatcacagcgtcgacacccctatgcatcgatctcgctgatccagtctcacgccaccccgcagcattgtgaggtcagggtgcacgggctgccggtgttgtttccgtacgtcgcactatccggctatcgacgtccaggttttcccgagggctgtcctggctacaggcaaatttgaggcacaaaaaacccagcgaaggctgggctgttgaaagtctgcaggggtcaaagatcgaatgcgctgatgggacgcgcctgcttggcaatttcctttttggtttttttccacgagcgctcgagatctgagaaatcgtcgtcgacaccccatcgctgcccccagccagcagataggcttcgtacccgaaatacccgaccacatcggctttatgtgcatgaacctcagtgggatcccatgccgcatcatgaatggcgctcagatgttggcttgccaaggccttgtcagtcgcgatccacgcaaaatcactagcatgctgacggctgagctgcttcagcgtcgaatcaggtatatccaaatcgggatatgagcaggccggccaatcttgatagtctcgctctggagtgagctgcgcagtgaaatctttatagtcccaaacgttgcgtcggctttgaagtacgtacaaatcaagttttgcgaccaggccaatagcagcaaagactgcttcctgcttccgctctcggcttttgaaaagcaagtctttagcccagccaatgaaggcagccacaacaccgctcgcgagaacgatttttacgatctcgccccaacccaagactgcgttagtcacctgaaccacttccaagatcacgctccataaacaacccggcacggtggccgggttatacaaacaagcttgcaatgcgggattgtgttacctcacaacaccgaggtccacaatagctttacgccggcgctctatcaaagcatcagcctcggactctgtcagctcttcagcaatgactacgatgccatggaatacggtccaacagcgcacgcctctagaatgcttgttccgctcctttcttaagctgtccatcccttacctcccttgcataaaggagatgattctatcagcccaaaagacaacagccctacgataactcactcgatcttgtcgcgcagctggcgaagtaaatccacacgagactccctgattcggcatgcctatctctggacttcactaaagaaaaatggatgatggaaagcagcaagccaccatgacatacaaggaagatgtaatgagcgaagtaaaccaagagggacgctactggctagtgccgtacaaaagttcggtgaaccagctaggacccagaagccaatatgagttcctccacgccgtgttttggagtggaactgaggtaggggcttcagacctagcgtgggaaatcatcagcaaaacattggatgaaggattcgttgataaaaaagcgaaccagcatctgaaacagattctgagtacaggacgcaacttcccaatactgtgcaaccccatagcaccgaagccgagcggacaaggtaacgtttgcgagtatggcttgggggttgatctaattggattggaaggtattctcgcaaaatcggaaagttggaaaaccataaccgaagagcagtaccgaaccctgtatttcggaaagtgaaaaaaacccggctcattggccgggttttctctgtggtgtcgcgcttgaaaagctgaacaccgtgtcataaaaccataccgttatccgtacggaaaggacttttacgcagcctctgccgattgatccaaagccccatcaatccagccgacgccggccttgatcagctcccaggccttgcgctctgacatgccgttttcccttccaatacggttggctggccatttagagccgaaatagagccagacgaaatcccccatctgctggtcgcgcttgattagccgcgcaagaagctggtcaaccacgagagcaacatcatcggtaatgacatacaccttcgtacttttcacaggatttctctgactcattaccgcggccatctgagagacgtatccaggaactcccatcccgtccatccgccaccacccccactgttcaagcagatactcggtatcgccaagtggcttgtcgaaatacgtgcgctttttcatgctgctttcctcggggcaggatcgctcaggccaaacagatcacgaagaagccggtctgctggcttgttcttagcattcccctcaatcagccaacgctgaccaaaatcgtggaaaccgatctcagctcggaggccatgccaggtcgcgaccatgtccagcaggtacgccaaagctgtaggtcctccgaccttcactttcgccaactcttcgccggcgatcttcaagaactggcgctccaactcgctcatgcttttacgcggaagcattgccgctactcggctactcatacggtccccttgtatttacttgcgaaggggcggcgattcatctcgacctcttcgtctgatggtggtcgcccctcaaaatcaacaaagcgaacaaactgcccctgctgctggacaatgcaggaccctgccttggcgtgccgaaccttacccacgatcaactcggtaacgccgttctgaccttcctcactttccttgtcgcagtgcacaaggatcaccacatcagcgtcctgttcaatctgcccggagtcgcgcagatcgcttgggcgtggacgcttgtccggccgattggttgagccgcggttgagctgtgccagcacaaccacgggcaccattagctccttggccaagttcttcagcgctgttgagattttgcccacctcaagggtgcggttctgcccaccctctgctgtgatcagctggatgtagtccaccagcaatacgtcgagcccttcacggcgctgacactgcctggcgatagagcgaatccgcgccatcgtcatcccagcctggtcgttcacgtagaggcgagcaccgttcagcttattcacggcagaggtgagttttggccagtcgtcgtcctcaagatcacctcgatccagccgggtaagattcactgaaccaatagaagccagaccccgggttacaagctcctccttggtcatttccatggagaacaccagcccagcgccaccgagctgacaggtgatgtgttggccaatctgcagacctaatgtcgtctttccggagcccgcaagaccgccgatgacgatcatgttgccaggacgaagtccgcagatgatttcgtcgagcttctccaagccagtgcctagaccgcgaggggatgtcttgttgaacttggcgtcgatagtgtcgacgaccgtcgtcaggatctcgcttgcccgatagtaatcctggtgtccgtcatccaagtcacgcaggtctgcggtagcctgctgagccaaagcaatgatctctgtcactgggcgctcttcactggcctgctcacggatcacatctgccgcagcgaccacctgacgcaacacagcgcgttcacgaacgacacgggcataagctttccagttagccgtacttcgcacaccagcagcgatttcgccagcataggccagggtcgacgttccactgggcaggcgttggcggtagtcccccaaggtcaccacatcaatcggaatgcccgctgcatgacagtcaatcatggtctggtacagggcagcgttttcaagttcgtggaagtcagacacccgcacctttgcagtgacctcttcgaaaagctccggctccagcagaatggcaccgatcaccccatgctctgattcaatgctgaacagttcgcgactcatacagcacctcgtgccgaggcccaggtgaaaccgatagcttgcccaccgccctggcgcaaacggtccaccgctcgatcaccgatataacggctcaaatctgcagtgaccaaatttgaaaccacaaccgtcggcaggacgagctggtagcgtcgatcgatcacttcatgaagaacccctagctcgtatgcgctaccactctgggcaccgacttcatcgatcactagcagatcaaagcttgagagctcgctcagaacatctctgtccgaatactcagcgtctcggtccatagctcccttgaagacacgaatgatctcggctgctgtagtgataactgcttgagcaccatgctcacggatcaccgcctgaaccaacgcgcatgcaagatgagtcttcccattgccgacgttgcccgaaaggatgagtgaacgaccggcagcgtagttatcggagaactgagcaacgtagtccttgcatgcgttgagggccttggccatgccaacgtcccctgcagtagtcctgtaactgtcgaatgtgcacccttggaaccgtggtgcaataccagcgcctacgagcagcctgttgaggtcctcagccttcttcctaccgctcgcctgggtatacgcctcactgggccttggtgctgtatgcagggcctcccagtggcagtgtttacaccctcgagcaagcacagaaccatcgaactgctctgtctctgaagtgttcaccgagccatggatcgggcattcgatatcaaagaaacgaacacgaggctgccgacaaaaattagaagttagcttggccattcggcacctccggatacatcccctgggtgtggttcggcaggccgtgataggccgaacttttggaagcaactgaacctacgcttggaaggagctcatcctcccaacggcgagcattcagccaggacgcgggcaacggtatgtactggccaccgtccttctgccattcaggttgcttacagtgttcagctagagccttgagtatcacgacctgttgctcactcgatggcgcaagcttcttccaagcctgttcagcagccggtcgtttctgtcgacgagggtagagtttgtaaaactggtcaaagccttccgctaggtcagttttggacaaaggttcttcagtccttactggttttttcagtccttgcttaatatcaatacttactagtgtcggatttgccgtatacggctgagccgtttccggtaaagccggaagcggttcatccggaagcggtgtttcagagaccaaatagttgatttcgccaagcactccagagccagagcgatcctgctgacgacgcacataaccagcactgatcaactcctgcagcagggaatacacaccgtcccgtccagttggctttgttgactgcgcagtctccccacgaagatgtgcgaccgaaatttcccagtgatcaggcttacccagaaggaataccagcaacccgcgggccgcccagctaagccgggcgtcctcgctgatccctttgtcgagtaggtagaagttcgcctcaggacgaggcgcccgaatgatccccataggtcagagctccatctcgtcagtgactcgtttgatgaacgcctcataagactcggccatgacgaagccctgatcttccagagcctgccggtatgcctttgcactcccgtaaagcacccaacgatcgcgctcaggcagacttcggaagctggcataggtaggccaagggccggcgatcttgcaagctgtagagggctcaagatgaggctgccgtaaaatactcatacggcctcctcctcgctcgtatgttttcccaataggtcctgaagcttttctgcccgaaccattaactgggtaccaacgatctgaagtccttcagctattccacctacgatgtaaccattgaggatcttctcgacagagcaaggagcctctgctgctaggtcgtgaaagagacggtcaggagcgtcgacaaagtagcctgcggattgcatcgaactagcttcatcagatatgcgtttcaaggtgagtgtctgtaagctcattggtcgttctcctccaccgacggttcaaagcgggcttctccagatcgcatagctcgaagaccaagcacagcagctcttgccaccgactctgcaaagccgatctccaggtttgtgtagcgaccacccatgccggtgatcgcgaactcaattgcgtgaaaggcttccgtttcatcaaatgccgccaacgcacttatctctgactcaaagaagccaatcccccttccccaatcagctgcgaccccagggttgttacgaggccagttgatcatgcgtccctgcttatcacgcgacgtgaaactcaggtcgtcacgcgtacgagttagcggaaaactcactgtcatcagtgggcgaacttgttcactacggattgcgtgtgccatgattaggtacctcttcgagatgtgctgtcctggttgcacaggacgattaatgagcccggttcccgccgggtttgttgctttctgggccgggcgaatctcatcatccacccttgtgaaataatgcaagtcccgctctgcccagctgtttcactcgggtagccacatcatcagcgctgcctcaagagaaagtaatttcaggtccacttaaggttttagtgggcccacttaggccaccttcaccgactcctccaacaccagtaagctctgccgcacatggccgatttctttctggatacctgccttctcgatctgcattacacgaccatctgtcatggcgtcgtgaactgcacgagagacatcacctgactcagctgccaggtgcaccaacgcctgaaccagactgaccccttcctgcttcacctgaggtaccagtgcatagcccagggcgcttgccagaagctctagtggctcagggttcttgctgtgcaccagaatctgtagaaactgctccaggttcagccggtgcgagtcgtcgtttggattgctgcgattgagcagcgcggtatggctcatgcccatcagatgagccaactgcttcggccccgcttccagcactgcctcatgaattgcgcgatgtacctgttccattcgggaaacctcttcgtggttgtcgtggcagtgctttcgcctgatgagcacaatgaactggtcgtatcaggaagacttttaatcaagtttaaagactgagtttctgggctagccgaggtcgaaatcaggccgcggattgcttcgtttcggtcgcggtatttcgcaagtacgcccaatcgacatcaggtctaagctcctcacaggtcaccgccctccccgactcgcgctcaagcttgatagcgagagctggattggctcggcgtacgttgtaagcaacctgcttgagttggcccacgctggtatcgcaacgcttagccagggcatccagcgaaacggcgtccagggagcgcatgagttcgattagcgtcatggtcattctcctaagagcctcaagattactctttgctaatttaataaacaatagcaatttataatttactgtttgctaacgcagggacactattagtctatggatatgaaaacccttcgggtcgaagcgctgcggcgtgtcatcggcccactcagccagaaagacttcgccgaccagcacgatctggacgcttcctatctgtcccagatcctcaacgggcatcgaggcctaggcgagaaagcggcgctcaatctcgaacagaaaattggcttggcaccaggcgttctggtcaaccctggcggttatggctcaaacctcatcgagggagagttcactcgccacgaagttcgagaccaaacatcccctgcctacaaagccctccagcaaactgcctcgcccagggcgattgctgtgatcgaaaaacttgccagagccgcggctaagggaaagcttaaggagtctgatctggtgctgctggaaggcatcgccggcttgcttgagaaggccaacgccgaaaaaccttaagccagatgcaaaaagcccggcacttggccgggcttaataggtagtcaacgcatcaaacagtgttaagacgctcgaccatatcagggaaacgctgaaccagcttaatcagcaatgctgcctgggcattcggctttgacttcgactgctcccaatttttcagcgtgtccggactggtgcgaatttgtctggcgaacactggctgcgacatatgaagcttttcacggatagaaatgatctcagcggcagtcacctctggtgcagggagagcttccatctcgtactgacgaagagtgatcttccccttccgatgctcgcccatctcttccacaccttgcatcaactcagcaaatagatcgcgctttttcatttcccacctcgctttttcagctctgcatcaatcgcagctttcagtgccttctcctggtcggaagtcagctttgtaacctcgtccttgtcgtagatcgaaaacatccaaaactgatcgttatcaagcagccagtagtagatgacacgaagcccgccacgcttcccctttcctctacgggagtcatgccaacgaagctttctgaatccccccgtacgcggcatcacatcgccagccgtagggttcgcctgcatctccgcttgaagctgccgatattcatcgtcagtcagatagtcgcctaccgtggcggtaaagcttgtagtttcaaagaagactgttttcattggggataagtatacgcaaattgcctacatttaaacagcgcggcagcacaccccttttcctggtccgctgatacgccatcgagattaatcaacactccaaacaaaagcccggcgctcgaccgggctctgtctcctactccagcaagtccgtttccctgctctgccacatggcctgcagcttggtcagccccttgccggtgatcagcgtcgagcacgttgggatcgtgccctgggtcggatgatcgaaggtccccagcttcacatcgagcaacccggcctcgatcttcgcctggtacggctcattagtcctggtcacccagcccttctgccgcatgaactgcaacaacctggtacggccagtgccaatgatcttcgcagcctgggcagcgttgtacgtcttgtgcgacaccacaaccatgtcgtggaaagccaccttcggcgcgtcctgctcgaccttcacttccagcagatggttctctttagtcagctcgttgttgtcagcctccaatgcgacaacctttgtcacgttttcattaagcaacgccaacagggttcgaggatcgcgtagagccgccatgtagtcgaaggctggcttggctacctgctcttccaactcttgccagcgatcgaccaggcgggctgtgaactcagggcagagctgggcgacgatgatataggtgtcacgcttgcagatttgatagacctgagtagcacgtagccgcccaatagagtctggtgcctgttcatccgccattggcggttggacaatcacccctcgagaaacaaggcgatcaatggagcgttttacatcatcatgtcgagagcccaccaggtccgcgatctcacgagaggacatggagggatgcgacacaccttgttgaatctgaaaatgcggtgcggcgacaggctgaccatgctggctagaggaaatattcattacgcttcctccaggccagcttggactgagtcgatcacagccttcgccgaatctactgctcggtaaaacgaccaagcgttgattggcggtatggagtctctccccattgccatgaactcgagctgccctttgagctcgctgaggatgcaagacgcctcaccaagcgcatctattacagaaatgcctgagcaaacagcgaacagttcctgacgctcgctattgcaacgggtgaatgaactctcaacggtgaccggcaccttgctagcgccagcattgagtttttcggttacttcggtatgcttattcatgtgaatgtccttcaaagtattcgcacccaaagccctggcgtctcgtacacgccggggcttttcttcaagacgcaatcgccttccccttctcgcgccccgctgctctcaagaacaaagcctcttcgatcaaaagcccaagttctgcattgatactccgccgattttcctttgctatctcctccacacagtgacgaacgcctacaggcagccttaatgaaaacggtgcttccttcggtttactgttcataaatttcctcctcattgactccttttttgtgagtcacggtgaaactatagtcacggtgactcatttccgtcaagtcatcgtgatgctatggtgactcacacccagcccggagacgatcatgagtagagacatcactccttttgcattgcgcatgccccccgagctacgcgctcaagtcgaagatgcagccaaatccaaagggcgatctctaaactcggaaatactggcgcgccttgaggcttccttcacagatgccggcctacctgccgaagaaacacgagagcgattcgatgagctcacatatgtgattcgacactttgaaggcagcctgaacaggggattcaatcacttagcaaccactgtctatgagattgccaaacagttgaatcaggcggaaataaatcacgatctttcaggcttaactaacaagccaaatcatccagacacaaaaatatctgacctgcccgaccccgacgcagaaccaccagtgacaaagcgaattccaagaacgagaaaaccgcaaaattcatgacagggacgctctcgcagcacccccccctccagcccagcaactctttgcccctgatcactacggcaagacatagattgaatgcaaagttattcacaggccagagtcaaactcacagtaataggtaacctattcctttgagcccacgggggctgaccatgcaaagcccccagaatcaaagcctaaataataggttacctattattttgacctaatagcgccgcttcccttcccgcgccatccaatcactgccgcaagccgctttacacgcaagccaggcttcttcatagaaccaacgtcaggctctccgcgggatctaagccaatcgagaactaggctctgagcccctcgccctcccggacctgaagggtcgcgtgttccgttttcagtaaccgcttgccagcactggaaagcctcgtaaagccccttgggatgaaccgggctttctgggttgaagcagttcgtaaacttatcaagctcagccttcaacaattcgatttgctcatccctttcctggatctttttatccttggctcggagctcgttataaagacttcgactatcgtcgactgaagctttttctttggctttcagctcgacaattaatgactctgcctcagctagacgaacctgaatatcttgtagggcgagtcgattccctgcagagcgcgcaacctccttactgttattaacctcagatgggcggtcgctggcgagacgattgaacccctgaaacctctccccgctcgattcatcaataaaagtttgagttacctccccgacctgtggaccaaccctcttctcggcggcgctcacctgccgctcaagccactccctattgaccatgaccttatttgaatcaaccgcactctgccgcgtttcaaataatgccggcacatgcctacctgttgctcttctaaaatactcagaaagctcggagtaagtaatcgctatacccagaagggtgtttttctctcccttgatatagatagtttcgggattgaactcagcatctggctggacaattgaagatagctgatcagcaatggatgcaagcaccgccaagctcttacccttgacctccgagcaggatacgtccaacgatacgtactctcgcaccaattcctgccctccttccaaaactgagcccaatacctaccactggctatccaaccagcaatggcactaagtctatcgccagttagcaaaatgtaatagccagcgctgcacaacccaggaacacaacctggcggtgacttgtgaaaagctaagctgtcatgagagctcccgcctccacgcgagtagtgggcttccccctcatggatttctggagtccaaacatggctgacaaatctgccgagtacgctcgaaacacactcaactcgctaatagccggtggctatgttcagggtctaactcaaaatcgaccgggtgaggccagccttcggattgatatggagatccttcgcagtcttgaggcacagctccgggagtactactcaaccgggccatatcaagaccccagcgcgaacggcactcccttgagtatctgagaaggcgataagacatggagctcgaggcgtttagcacttgtgcggactatcacagaaccggccgcgctatggcaggatgcccagcatcactcgctgaatcatggatggagtttgaaaagtgacatgcgatgagctttcagggtgtctagaaagtccagggcgattcacacactggatttaggttccagcgccgcaaggagtaagagctcgagtctcttcgtctgcagcaccgatcaactaaaagcgccgctttaccttccatgctccattgcaccacgtgggttcaagttctgcgcacagcaaaaggtgaggggcaccggttttttcatttattggaccaacgagtgctgcgcagaggcgcccagcaatatcggttgggacattttcacctaagaaccctgcaacggatttatttaggccttcgtctgtcggtacgtgaattaccgcgaacgcaccggactcctttgactggctggtggcaattaccaggcaaggggtcaactcgttctcgatgagagaggtgtccatgtacttgcatgcgtactcaagagcgcttttgccgtctttgaaatgaagctcaggaagtgccttttccacctcaaccgtagaggagccatttttaacccattggattagacgacctgtaacgctgtcataaaggaacgaaagcagagaccctgcgacgaccaaataactaccataaagaacggcggggtgctgccgagcgctgtccctgtctaaaagaacggtatcgagccactcatcgaagaatctggatgcacccatatgcgaccagtgcattttgtataggcctatcagaagtatcaggccaccaaccgcaagcaaaactatgccggtacgcttagttgcagtatttgcaaaggcttccatgtccactcccaagattcccgctatgccagccccaccttaatggagggtcacaatcctgcggctttcgccaatcctgatccgatcgagcgcccgatttagcgcgtccagggcgtcgaggagggctttggcctcagcctctcgtccatccccccaaagccgctcagccattttgttgagagcctggatggatcgctcgatatcagcagcagtcactgccttggtatcctccggctgtttctttgccattcaataacacttccacggcgctggatgatcagcgcgaacaacgcattcagaacacaggtcgccatcaaacctgacagccttgaagcaggccccaacacgaattcttcgatgcgaaatttagcaccattacttcgccactacgattagcaacgtccccgccctgccgcgatcaaaaattagcaaactgaaatttagcaaaatgcattgcataaaaattacattatgctaatttagctaaacgccaaccaaggcgttgaaccaccccatccatttttgcgaaagccaacaacgcggcaggccctcggcttgcctggagaaaagcatgcctacatccacgacctcttctcaagggaatgagttcgccaaccttggcgctcgcctgattcgcttcggccaggcgctgcaggaaggctcgacaaccgtcggtgaactcacctccctggcagcagcatgcggtatcagcttcaagctgaaagctactgcggagcagggagagccccagaatggctagaacactccttcgggtccgaagtaagggtgtggccttctacctgaactctgaaacctcatcccccaataccgggcaccggaatcgctaccgcctgttcaagacgaagaactacggccgcgaaaagtcgggctggattcaagtgggttcgattgctggtagggagttgatggcgattcagggagagatagccttgctagaagcttgtgaggcgctattcagcagcaagaaacctcaccgctatgaccaccatggtgcgatacgtggcaagccgggcaagtgggagggagaggcattcccttatcgaatggacatgcccatcagcagctcaggaggagtccgccgcagcccaccggaaagtcgacggatagtcaggacaacggactgggcgaacaactcaacgatagccgcgcgcaacgccggtaaccatcagagccttccaaaatgcccacccccgaaatctgaactggcgcccgtcccggccagcacattcgcccctttacgaacgcgctgggccggtcgagcggcgcaactttacaaactgttgcagcaactgtcccgcacacaattctgaataaacctgaaggcccgccacacgcgggcgaggaatccccatggcaaatgccacagcagccaaggccacaagtattcagccgcgcttcatccgcttcggtgatgcgcctggctatctcggcatgtgcaaggacgaattcaacaaaaccgtcagaccaaacgtccgggaattcccgatagggaaacaaggggtcgccttcgatcgtcatgaactggacgagtgggctgacacctacatcacgaccagggcgattgaaaaagccaccattcaggacaacaatcggcctcgcagcgagcgccaaggagcaacacaatggcgcgaaaaacgatctccggtctctaccagaaaggtggcatctggcaaatcgacaaggtcttccggggcgagcgacttcgagaaagcactggaactggtgaccggcaagaagcagagcagtatctgattcacaggcttgaaaagttacgccaggagcgcgtttacggtgttcgccgtacacgcacctgggaggcagcagcgacgcgattcctgcttgagtacaaggaccaaccctcaatcaagctttcggcacaccacctcactcaccttcatccctatttgaaggatctgccgttgactcacatcgacgaccaggcacttgaggagtttgtggctgatcgattgaacggaatggttctaccgtgcggcaagcagctgaagccagttgcacctcgcacagtgaacatttccattgagcgggtgatccggattctgtcgctctgcgcaagaaagtggcgggatgaagagcgtaggccctggctcgactcggtgccgatgctgacaaagctcgatttgaagaagaaggtgcggctgccctacccgatgacttgggacgagcagtcgatcctctttggagagctgccgacgcacctgcagaagatggccctgttcaaggtgaacacgggttgccgggagcaggaggtctgcaagttgagatgggattgggaaatccaggtgccggaactggggaccagtgtttttctgatcccttccgacttcggcggccgtaacgagcgatccggcgtgaagaatggcgacgagcgcctggtggtgctcaatgccgtggccaagtcggttatcgacaagcagcgcggactgagtaaagagtgggtgtttccgtacaacggcacagccatgcacaggatgaatgactctgcatggaaaaaagcacgggtgagagcggcgaaactctggcaggaggaaaaccttcgccccgctcacccaggttatgcatccataaggatccacgacctcaagcatacgtttggtcgccggcttcgcgcagcaggcgtgacagaggaagaccggaaggccttgctcggtcataagaacggcagcatcaccagccactactccggcgcggagcttgagaagctgattgacgctgcaaatagggtatcagccacggactcacgcgggcctgtactgacgattttgaagaggagggcaggatgaagtcccgaaaatctccccacaaatgaaaaagcccaacctgtgaagattgggctaagtcattgaaaaatatggtcgggacggagtgattcgaacactcgacccctagcaccccatgctagtgcgctaccggactgcgctacgccccgactaggcgtgttactgggtttgcttcttaacgaagcgctcaagaatatatcgcaagcttttgaaatttggaagtattttaaaagctgaaaatcatttcttgagtaccaccagaacgtcctccagttcggagatcatctgacggatcaattgcttgtactgggtggtgtcgtctttggcttcatcaccggaaaggcgtaggcgtgctccaccaatggtgaacccctgatcatacagcaacgcgcggatctgccggatcatcagcacatcctggcgctgataataccggcgatttccgcggcgcttgacggggttgagctgaggaaactcctgctcccaataacgcagcacatgcggtttgaccgcacagagctcgctgacttcaccaatggtgaagtagcgcttgcccggaatgaccgggagctcgtcgttatgacttggttccagcataagcctcaactcgggccttcaacttctgccctggacgaaaggtgaccacacggcgtgccgtgatcgggatttcttcacccgtcttcgggttacggccaggtcgctggcgtttatcccgaagatcgaagttaccgaaaccggacagtttgacctgttcgttatcttcgagagcgtgcctgatttcctcaaaaaacagctcgaccaattccttggcctcacgtttattcaggcccagctcttcgtagagacgttcggccatttcagctttcgtcagagcccccatacgtcacttccttaacgtggcgttcaacctttgttcgagcgaggtgaggatattttgcgtcgtggagttcacctcatcgtcattaagagtgcgcgatggatgctgccaggtcaagccaactgcaaggctttttctatgaggatcaatgcctttaccctggtacacgtcaaacaacctgaggtctgtcagccattcgcctgcattctcacggattacatccagcaccgcactggcagcaacatcgcgatcagccagcaaagccaagtcacgacgcacttcaggaaagcgcgacaactcacggaattcgggcatttttcccgaggctacttcggccagaaccagctcgaaaacgaagaccggacggtcgagaccgagggttttcgacaactcagggtggatagcgccaatataaccaaccagacgaccttcacgctcgatgcgcgcggtttgacccgggtgcaacgcagggtgcttaccaggcacgaaagtgaacgcatcgagtgcaccggcaaaacccagcaccgcttccacgtcggccttgacgtcgaagaagtccacgacatcgcgaccttgtgcccagccttccggcagacgagtaccgcataccacaccggccagcatcggctcttgcttcaagccttccagttgaccgacgaaacgcaggccgctctcaaacagacggacacggtcctgctggcggttcaggttgtgctgaagcgccttgaccagccctggccacagcgaggaacgcatggcagccatgtcgttggaaatcgggttggccagcaacagcggctcgactcccggattaaacaactcgaactgtttcggatcgatgaagctgtaagtaatagcttcctgatagccgcgggccaccagcaaacgacgcagctcaggcagatcgctacgagcttcggccttggcttgtggagccaggcgcgcctgagggtagcgaaccggtaggcggttgtaaccgtacaggcgagccagttcttcgatcagatcgacttccaggctgatgtcgaagcgatggcttggcacttcaacgcgccactgccctgctccatcggcggaaatcttcagacccagagcaccgagcagacgctcgacttctgccgcttcgatttccatgcccagcatctgggtgatgcgctcggcacgcagagtgaccggcgcgatcgacggcaggtgctgctcgctgactgcttcaatgatcgggccagcttcgccaccagtaatctccagcagcaagccggtggcgcgctccatggcttcacgggctaattgccagtccacaccacgctcgtagcgatgcgaggcgtcggtgtgcaggccataggagcgggctttaccagcgacagcgatctggtcgaagaaggcactttccaggaaaacgtcgcgggtagttgccgctacaccgctgtgctcgccgcccatgacaccggcaatcgccagggcacgggtatggtcggcgataatcagggtatcgctgcgcagggccacttcctggccgtcgagcaagaccagcttctcgccctcttcggccatccgcacacggatgccaccgttgatttcggcgaggtcgaaagcatgcagcggttgccccagttccagcatcacgtagttggtgatgtctacggccgcatcgatgctgcgtacatcagcgcgacgcagacgctcgaccatccacagcggggtcggcttggacagatcaacattacggataacccggcccagataacgcgggcaagctgcgggcgccagcacttcaaccgaacgcacttcatcgtgcgcaggtgccacggatagcaccaccggacgggcgacaggcgctgcgtagagcgcgccgacttcacgggcgagccccgccagcgacaggcaatcaccacgattcggggtcaggtcgacctcaatgctggcatcgtccagctccaggtactcacggaaatccttgcctaccggcgcatcggccggcaattccatcagaccgtcattgccctctcccacctgcagttctgcctgggagcacagcatgccgttcgactctacgccacgcagcttggccttcttgatcttgaagtcgccaggcagctccgcgccgatcatggcgaaagggatcttcaggcccggacgcacgtttggcgcaccgcacacgacctggaaggtttccgcaccattgctgacctggcaaacacgcagtttgtcagcatcagggtgttgctcggtgctcagcacctcgcccaccaccacgccactgaaaacaccggcggccggcgttacgctatcgacctcaagaccggccatcgacagacgagcaaccagctcgtcgcgacttacctgcgggcttacccagccgcgcagccattgttcactgaatttcatcctgctctcctgaaagattcgttacgggcgtgcgacctagcgaaattgcgcgaggaaccgcaagtcgttgtcgaagaacaggcgcaagtcattcacgccgtaacgcagcatggccagacgctcggcacccatgccaaaggcaaaaccctggaactcttccggatcgatcccggacatgcgcagcacgttcgggtgaaccatgccgcagcccatgacttccagccatccagtctgcttgcagacacggcagcccttgccgctgcacatcacacattccatgtcgacttcagcggacggctcggtgaacgggaagtacgaaggacggaagcgcactgccagttctttttcgaagaacacccgcaggaactcttcgatggtccctttgaggtcggcgaaattgatgtcgcgatcgatcagcaggccttcgacctgatggaacatcggcgagtgggtgatatcggagtcgctacggtacacacggcctgggcagacgatgcggatcggcggctgctgcgattccatggtgcggacctgtaccggagaggtatgggtgcgcaacaacatgttcgcattgaaatagaaggtgtcatgcatcgaacgggccgggtggtggcctgggatgttgagcgcctcgaagttgtgatagtcgtcttcgacctcagggccttcggcgatgccgtagccgatatgggtgaagaactgttcaatacgttccagagtccgggtcacaggatgcaaaccgccggagacctggccacggccaggcagggtcacatcgatggactcggcggacagtttggcagccagctcggcttcttcaaacaaagccttacgcgtattgagagcctctgtaacacgctccttggcaacgttgatctgggcgccgacctgcgggcgctcctctgccggcaaattccccagggtcttcatcacctgagtcaattcacccttcttgccaaggtactgaacccggatttgctccagggcattgatatcttcagcgctttgcacagcctctagtgcttgagagaccagcgcatccaggttttccatgtacagactccagatacaaaataggggaagagcttgtaggctcttcccctatttatgacgtttaacacctggacccacagaggtgagcccgggtgactgtcgggggtacttaagccagagtggctttagctttctcgacaatcgcagcaaacgccgctttttcgttcactgccagatcagccagaaccttacggtcgatctcgatggacgcttttttcaggccggcgatgaaacggctgtaggacagaccgttgatacgagcaccagcgttgatacgagcgatccacagagcgcggaactgacgttttttctgacgacggtcgcggtaggcgtattggcctgccttgattaccgcttgcttggcaacacggaatacgcgggagcgcgcgccgtagtagcctttagcaagtttcagaatttttttgtgacgtttacgggcaatgacgccacgctttacacgagccatgagttacttcctctattcttgatccaaaaattaacgaaggcgcagcatgcgctcgacttttgccacgtcagacggatgcagcaagctgctaccgcgcagttgacgcttacgcttggtcgacattttggtcaggatgtggctcttgaaagcgtgcttgtgcttgataccgttagcagttttcagaaaccgcttagcagcaccacttttggttttcatctttggcatgttcggatactccgcattcagttgataaacataatcagaaggcctgccgtgccctgttgattacttcttctttttcggggcgatgaccatgatcagctggcgtccttccatcttaggatgctgttcgaccgaaccgtactcttgcaggtcagcttcaacccgcttgaggagttccatccccagctcctggtgggccatctcacggccgcggaatcgcaaggataccttggccctgtccccgtcactcaggaaacgtaccaggttgcgcagttttacctggtaatccccttcctccgtccctggacgaaacttgatttcttttacctgaatctgcttctggttcttcttcgccgcggcaatctgcttcttcttctcgaagatcgacttgccgtagtccatcacgcggcaaaccggtgggactgcgtcggcggagatttccaccagatcaagcttggcttcttcagcaatacgaagcgcttcatcaatcgagacgatgccaatctgctcgccgtcagcgccaattaaccgaacctcgcgtgccgagatattctcgttgatcggggctttcggtgcagctcgtttatcttgtctcatttcacgcttaataataattactccgaatctgggcgaccacgccgggaaaccgcttgtgcaaggaactccgagaattgggcgacgggcatggagcccaggtcagcaccttcacgggtacgcacagcgacagtctgcgtctcgacttcccgatctccaataaccaagagatagggaaccttgagcaaagtatgctcgcggattttaaagccgatcttttcatttctcaagtcggacttggcacgaaatccgctttggttgagggttttttccacttcgagggcaaaatctgcctgtttatcagtgatattcatcactacggcctgggtcggagccagccacgcagggaatgccccttcgtaatgctcgatcagaataccgacgaaacgctcgaaggagccgaggatcgcccggtgcaacatcaccggatgcttacggctgttatcttcggaaacgtactcggcgcccagacggatcggcaggttgaaatcgagctgcagggtaccacactgccagacacgacccaggcagtctttcagcgagaactcgattttcggaccgtagaacgccccttcgcccggttgcaggtcatacggcagcccggcgctatcaagcgcggcggccaaggcattttcagcgcgatcccacagctcgtcggaacccacacgcttttcagggcgagtggaaagcttcatttcgatgtccttgaagccgaagtcggcatagacatccatggtcagcttgatgaacgcggcggattcagcctgcatttgctcttcggtgcagaagatatgcgcatcgtcctgggtgaaggcacgcacacgcatgatgccgtgcaatgcaccggacggctcgttacggtggcaggcaccgaactcggccagacgcatcggcagctcgcggtagctcttcaggccctgattgaatacctgcacgtggcacgggcagttcatcggcttgatggcgtagtcgcggctttccgactcggtggtgaacatgttttcggcgtagttggcccagtgcccggatttctcccacaggctgcgatcgaccacctgcggagtcttgatctccaagtagccattgtcgcgctgcaccttgcgcatgtactgctcgagcacctggtacagggtccagccgttcggatgccagaacaccatgcccggcgcttcttcctgggtatggaacaggcccaaacgcttgccgatcttgcgatggtcgcgcttctcggcttcttcgatacgctggatataagccgccagctgcttcttgtccgcccaggcagtgccatagacgcgctgcagttgctcgttcttggcatcgccgcgccagtaggcaccggacagcttggtcagtttgaaggacttgaggaagcgagtattcggcacgtgcggaccacggcacatgtcgacgtattcttcgtggtagtacaggcccatggcctgttcattcggcatgtcctcgaccagacgcagcttgtagtcttcgccgcgagccttgaacacttcgatcacttcggcacgcggagtgaccttcttgatgacgtcgtaatctttctcgatcagctgctgcatacgctgctcgatggccgccaggtcgtccggggtgaaaggacgctcgtaggcgatatcgtaatagaagccttcatcgatcaccggaccgataaccatcttcgctgtcggatacagctgcttgaccgcgtggccaaccaggtgagcgcaagagtggcgaatgatctccagcccctcttcatcctttggcgtgatgatttgcagggtcgcgtcgctgtcgatcagatcgcaggcgtcgaccagtttgccattgaccttgccggccacggtggccttggccagacctgcaccaatggatgcggcgacctcggctacggaaaccggatgatcgaatgaacgttgactgccgtcgggaagagtaatagtgggcatggcgcctcctctcctagtggtgacccctaccaaaggtcacgtgggttgggatgagccagtacgcggttcgatccaggccgttcgtgacgaacgcctgcctcacagtggcaggagccttgcggccaaccggtaaaacgaaccagagtgactggagttcaaatcagaaaaatagaggcatagaccgcggtgggattgaaattcgcccagagcctgaaaacacccaagccgggcatgctagcacagatgaacggtcatcgcgccgtacttcccaccgggaccagcgtatccgcgctttctttcgagaaagtgaacttggtgtgtacgcaaggtctcaaatacaccgagaatcgccattcttgtaccaatcccaggagagctcgactcatgcgcctcacccaactattcgcccttgccgccccttttgccctgctgctgccactgagcgcgcaagccgcctggccagccggggtacgtgccgaatacatgaaggattgcacggctgccgccagccagagcgttgatgtgaaaagtgcggaaaagcactgcgcctgtggtgcggacaagctcaatgagaaattcactaccgacgaaatcaaacagctcatgagcaagcagactcaaccggatccggcgctgagaaccaaggccctggacgctattgccgcttgccgggtggtgaaataagcctttaaagcgcgagagagggccttgaatcaggttcgatgcgatctgaaaaccggccttttttcacaatttacgcagcttttacggctttttttatcaccggatattttcagcgaaagccccttaaaccggggccttcagccgatcggagcaacaaaacggactcaagcacctgggaatcggcacgtccagggggctcccaagtcgaacatttcgactatgatagcccggtgtgcccagttggcctgagcagcacagtactactgaaaatatatgtttcttggagatacaccatgtctaatcgccaaaccggcaccgtaaaatggttcaacgatgaaaaaggcttcggcttcatcactcctcaaggtggcggtgacgacctgttcgtacacttcaaagctattgaaagcgacggtttcaaaagcctgaaagaaggccagaccgtttccttcgtggctgagaaaggccaaaagggtatgcaagctgcacaagttcgtcctgagtaatttctcagcgagctaaaaaaaccccgtccatgtgacggggttttttatgcaaggtgcaaaagcgctgacaggatcagccgcagttgacccgggttaccaccagattggtatcggtgtttaggttcagccgatcggaacggtattccagggtgatcatgtcgttcggcttgagaatacgggcgttctgcgcacctgcgcgagtacgcgcctgttccagcagctcaggcgaagcttttttgccgatggcgaattcggccgccttagcctcacagcggctatggccgctctcggtcgctaccggatccttatccggcgaagaagtgctgcaccccgtcaaaacgactgcagccaacaaggtaccgaatgacgcgagcttccaaggcatgaagcctccttttcaaaaataagcagagatagtgcgacaaccgctctgactattggtttcacaaacggactggccaatggcctcttggccaggcagcgggcaagtctgcatcaggtacggtcacgttttcatgcagcaatcgtgaccggatatgaacagcctcagtaaatatcgatgtaatcgaatggtggcttcggccagttctgtttcaacgcgttaaaaatctgcgtcacccagacctcatcgctggccgctacccgcccgacataaccggaaccggcggcccaggtctccagcctgaacagcaagccgtcgatgtccgcgccaccgaccacgcccgacgagatataggcaatgcccgccttggtcactcgcagctgggtatgcacatcgtcactggccgacgccagcaactggcgcaccgcctcgaaggtcaaggcatcagggttgttcaaatcgatctgcacactggcaccctttgaaaacagacaatgaccaagtgtcgcacagccctcccctcatgcctaagtcggagtgcgaaaagcccgccaaggtgtttaactctacaagaccggaagccctcgacaagcgcctgtccggccctatcctttccgagctcgcgagacttccatggccaccgtgacgatcgacgccgacatcaaagccaaatggcctgaaggccattgttcctacagccccggcagccccgaagagctggcgatcatcggcatcgacttgctgatcagggagctgggcaccgaagcggcccagacattcatcgagcagatattcgagaagtatcccggcgaacactcaggcacgccggatacagggaaggcgtagcgcccgacaggctggcacctgccgggaatatcacttacttcaggcgagccaggcgctcggtcagcagatcgaagaagccctgggcatcgccattctccacccagaacacgttcttctcctgcttcaggccgtcgtaccaatcgacgatggtctggccgaaggtcggaccttcacggctgtcgatcaccatgttggcctggcgcccgctgaacagctcgggcttgagcaggtaggcaacgacggtcgcgtcatgcaccgggccacccggaatgccgtagtgctccatgtcacccttgacgtattcgttgaggatatcgcccaccaccttgctggcattgttgttcaaggccgcgatcttctgcaggcgcgcatcgctggtcagcaccttgtgggtgacgtccagcggcaggtaagtcagcttcacgccactcttgagcaccacctcggcggcctgcggatcggcgaacaggttgaactcggccaccggggtgatgttgccgccattgaaatgcgccccgcccatgaccaccacttccttgatgccttgagtgatatccggtgcctggatcagcgccagcgccaggttggtctgcggccccagcatggcgatggtgatgctgtggggcttggcggcgcgcagggtgtcgatcaggtaattgatcgcactgccctcggccaggccctttttcggctcatgcaccgtgaccccggaaatgccttccttgccgtgaatattctcggcatagatcggcgtgcgcagcagcggcttcggcgcgccggcgtacaccggcacctcttcgcgccccgcccactcacgggccaggcgcgcattgcgcgaggtcttgtccaggcgcacgttgccggccaccgtggtcagcgcgcggatctgcagttcttccggcgatgccagggcgaacagcaacgcaaccacatcatcggcacccggatcggtatcgatgatcagatcgattttttctgccgcatgggcgctggtagcagtgaacagggacacgagcagaacactccggatcaggtgtttcagtagctgagcatagcggtgcatggcgcactcctttgcgtggttgaacagagagaggcaacgctcagaacgtcaccccggcaatcaaagcgatgttgcaataaggttgacactcccccgtacgaacgattgcccgcgcctggcggctgagcaccttgaactcatcgtggctcaacagcttgcgcgcgcccagcgccccctcggcgctcaacgcctcgagcgcttgcagggtcggggattgtcgatccaggatctcctgcgccagcacatggccttccacctgcatctcgcaaagcaccacctgcaaggtgctgagaaaatccggaataccctgggtcagggccaggtcgatcaactcgacgcccggcggcaccggcaggccggcatcgccgatgaccacgatatcgccgtgccccagggaggcaatcagtcgcgacagggcgacattgagcaagggtgtttttttcatgcgggagagaacgcctgtacgtcggacaacgtgggaatggaaggttgcgcacctgggcgggtcaccgacagcgctgccgcgacctgaccgaaacgaatcgcctcggcctcgctcttgccggcggccagggcggcggcaaaaccaccgacgaaggtatcgccggcggccgtggtgtcgaccgccttgaccttgggcgccggaaaatgctcgaagctcgtgccattggcgaacagcgagccctgggcgccgagcgtgatgatgaccttaccggccccggcggcgatcaagcgggcggccgcggcttcggcgctcgccagtgaatccactggcaagccgctgagggccgcggcctcgctttcgttgggaatcagatagtcgatggacgcgtaccaatccgccggcagagggccactggccggtgcagggttgaggatcactgtcttgcccagttcacggccgcgcttgaggctatgccccacagtgggcagcggcacttcgagctggcagatgattacatcagccgcctgcagcaccttgtcgaagccgctgaccacttctggcgtgagccgaccattgccaccggccacgatcacgatcgcgttctgactgctgtcgtccaccacgatcaaggcgacgccactggagccagagacggcggtgacggcctggcaatcgatccgctcggcgagcaacgccgagcgcaattgctcgccgtaggcatcatcaccgacgcagccgatcatcgacacctgggcacccaggcgggccgccgccaccgcctggttcgcccccttgccaccggaaaccgtggcgaacgactggccgatcagggtttcaccggcacgcggcaaccgctcggcccgggtgaccaggtccatattgaggctgcctactaccactacttttgctggcatacatcgatactcacaattcgattcaacggtactcggcgaatgcgccggccacgggcgccgtcgactcgcgcaggacaatgcttggggtgacgatacgctggtcagtcggcaatcctggggtggcaatgcggcgcagcaacagttccgccgcctgctcgcccagttgcaggatcgactggccaactgtagtcagcgccggatacacataacggctcatctggatgtcgtcgaagccgatcaccgacagttcgctcggcacccggatattgcgctccgccgccgcgcgcagcacaccgatgcccatcatgtcgttgctggcaaaaatcgcactgggcgggttgcgctccagcaactgggccgccgcgtgataaccgccggtgctggtgaagtcgctctgcaggatacgctgcgcaggcacctccacgccggcttcgcgcaacgcccgctggaaccccgccagacgtagctgcgccacgctggtgtagtccgggccgccgatgcaggcgatatcgcgatggcccaactcgagcagatgacgggtcgccagatatgcaccgtattcgtggtcgatacgcaccaggtccgcatccactccttccagcccgcggtcgacgatcaccatcggcgtgcgcacggcggccaggcccttggccagcccgccgtcgccaccggccgaggtcacgatcaggccgtcgatgcgtttttccagcagcacccgcaggtagctgcgctgtttttccgggtcgtcgtcggagttgcagagaatcacgcagtagccgttgcgctcgcaataatcctcgatcccccgggccagctcggcgaaatacgggttgaggctgttgggcaccaacaggccgatggtcgccgtggtcttggccttcagcgaacgcgccactgcgctgggcacgtagtcgagctgctggatcgccgcctcgaccttgatccgcacctcctcgctgaccggacgcgtcttgttcagcacgtgggaaaccgtggtgtaggaaatccctgcgagcgccgccacatctttgatcgttgccatgactcagctccgccggcttgcgcgctggctgcgataagtatccagcaccaccgcaatcacgataaccgcgccggtgatgatgcgtttggtcggctcggtcgcgccgatctgcgccagccccgcggccagcaccgagataatcaacaccccgaaaaaggtgctgatcaccgacccgcgtccgcccatcaggctggtaccgccgatcaccaccgccgcgatcacttgcagctccaggccggagccggcattcgggtccgcggcctccaggcgggaaatctggaacagcgcggcgatgcccgccagcagccccatcaggctgaacaccaggatcttgtagggcttgggattgatgcccgccaggcgcaccgcttcttcgttggtgccgatgccgatcaggtagcggccgaacaccgtgcgcgtcagcaccgcctgggcgatgaagatgatcagcaaggcgatgatgaacgatggcgagatgccaaaggcgatcgggttcgacaaccaggcgaaggcatcaccgatataggccgtgcgcgatccggtcatctggtaagccacgccgcgtgccatttccagcacgccgagggagacgatgaacgaaggaatgcgccaggcgacagtgatcgagccggtgatggtcccggccaatgccgcgcagcccatgcccagcaatgccgccgggatgacgttccagccccagccgagaatcgccacgctgacggtggaggccgccagggccagcaccgagccgacggacaaatcgatgccgccgatgatcaggacaaaggtcatgcccaccgccagcaccatcaggtccgggatctggttggccaaggtgctgaaggtgtcgtaggaaagaaagtggctgctcagtgtcgagaacagcgcaatcattgccagcaaggcaccggccagccccaggtaggtgcccaggccgtaatagttgccgccacgtttgccggccgaagatgcagttttcatgggaggtccctaggcgccgcttcgttgagcaacgcatcacgtttttgatagccggcgaaagcggcggcaagcagttcatcctgggtccagctgtcgcgctcgaaggtatcgatcaggcgcccggcggacagcacgccaatgcgatcgcagatcaacatcagctcccgcaggtcgctggagaccaccaccagcgccttgccctggcgggtcagttcgccaagcaggccatagatatcgaacttggcgccgacatcgatgccccgggtcggctcgtcgaacagtagcaccgcgcaatcgcgctccagccagcggccgatgactaccttctgctgattgccccctgacagttcagataccagctgcgcgggccccgaactgcgaatgcgcatggcatcgatttgccgctgcgccaatgccgattcgtcacgaccattgaccaggccgccactggagatctccggcatgttgcccagggcgatattggcgctgatggattgcgtcagcagcaggccttcacccttgcggtcctcggtaatcagggcaatgccgtgggccactgcatcgaccggcgaacggatattcgccacctgcgccggagaacccagggccaccgtgccgctgtcagccttgtcagcgccgaagatcagtcgcaacagttcggtgcgccccgccccgatcaacccggaaataccgaagatctcaccgctgcgcacctcgaaagacacgtccagaaccttgtcggaacgactcaggccgctgaccgtcagggccggcgcgccaatcttgcgcgggccgagatcgatgtgttcgcccagctcgcgccctaccatcaggttgaccagttgctcgctgttgtaattggccatcggctcgacacagaccaggcaaccgtcgcgcagcaccgcaatgcgctgcgcgacccgggccagctcttccaggcgatgggagatatagatgatggccacgccacgggcctgtagacgagtgatctgttcgaagagcaactcgacttcgcgggccgtgagcatcgcggtcggctcgtcgaggatcagcacatggcagtcgccgatcaggttgcgcgcgatctccaccatctgctggtggccaatccccagttctccgaccagcgtatcggggtcgatcgcctccaggccgacctgggccatggcttcgatcgccgccttgcgcaactgcttgcgactgatccagccgccgaggctgggcaggttatcgaggaacaggttctcggccaccgacagcgtcggcaacaggttgagttcctgcatgaccatgcggatgcccagctcttcggcctgggtgcgactgccgggacggtaagcctgaccgttgaagcgcatctcgccggtggtcggggtcaccaggccaccaatgattttcgacagggtgcttttgcccgcgccgttttccccggtcagcgccagcacttccccacgcatcagcgtcaggtcgatgccggtcaataccggttgcgcataggtcttgccgataccgctgaccgaaaggacagcgttcacagcggaaactgacataagaaactctccatgcgcccgcctgttcaggcgggcgccgttgcgccgccagaaagattactgggtgaccagctcaaccggagtttcgatcacgccattggcgccaccgtccaccttctcgcccttgaggatcttcagcgccgtctcgataccgaagaccgcctgcttggcggcgaactggtcggcggtcgccagcacgcgaccgtccttgagcatcggcttgatggcattgatgttgtcgtagccgaccaccttgaccttgccggccttgcccgccgcgcgcaccgccgagacggcaccgacggccatgctgtcgttgccggccagcagcgccttgaggttcgggtattcgctgagcatggcggcggcgacgcggttgccggcatcgatttcccaatcaccggattgcagcgagaccaccttgatctgcgcggcctccatcgcatccttgaagcctgcggtgcgctgctgggcgttggtggtggtcgacacgccttcgatgatgccgacttcgtccccggccttcagatccttggccaggtactcgcccaccagacgcgcgcccttgcggttgtcggggccgacaaaaggcacgctgatgtttttgcttttgagtacggccggatccagctggttgtcgatgttgatcacggtgataccggcgtccaccgccttcttgatcaccggcaccatggccttggagtccgccggggcgatcaccagcgcgttgaccttggaaacgatcatctgctcgacgatacggatctggttggcggtgtcggtttcatccttgatgccgttggaaaccaggtcgaaatcggcggcatggtctttttgatacgccttggcgccgtcttccatggtgaggaaaaactcgttggccagggatttcatgaccagggcgaccttgggtttttccggggtctcggcgaatgccgaagaaaggggaagcgtagcggatgcggcagccagaacagcgacagcgagaagacgtccagcgaatggcagcttcatgggttcactccgatcttatgattattgtgagcaacgcttgcgccggagtacgctcgacgaccttcagacccgattaacgcggcttgaagcgaacctgagaggtgtatgacttttatcgcccagggcctgcgcaaacgtttgcgtaaaacgaactatgcgaaccctgccgctatttgtcaacgggcaaaccaagcccatgagccgcccggaacgccaggacaggcgccccgtacgacatcacacaatcatgcggtggtactgaccagtgcgcctgacgaagcgtccttgctcagttccttgaccagcttccccaccacttcctgcaacgcaccgctggtatcggcgagctggccttgaatcgccatcacgaccgtcgctttggcttccggggtcgggtagctcgccgcctgggcagcagccaactgctgctgttgctcctgcaattgggcctgcagttctttcatgcgcttgagcagcattttcaccaccaggctttgattatccccttcagagccttgggtctctgccttctcggcctcggaagcggatgccactcgcagcttgccctcttcatcgatccccaaggcttgcgcagcgctatcggcggcaccctggctcagagcctcgatagtggccggtgatttaccgttgatggtgatggccccggcagcgggaaaaccgacagaaatagacatgtgagctccataaagaaacgatccttgaagggcatcggctgcaagggccttctctttaattcagccttttcctcaggctaaccagaactgtcggacaaccgaacgtaaatcttccgagcattcggaaaaccggacaacgaaacggccaccgaatccgataactaaaaataagttgatataaatcattaagttaaaagagttttgcgaccaaagtccgactggtacagatcctgctgttccctttcgcccgcggcattcagatctgtctcgggtgtatctagatgaacctgcaccagcaccgtctcactactagagagaaaataatgaaatctgctttcaacacccttgttccgggcgctttggccctcctcttgctccttccgactgcattgcaggccaaggaagtcgaaacccaacagaagctggccaacgtggtcgtactcgctaccggcggcaccattgccggcgctggcgccagtgccgccaacagcgccacctaccaggccgccaaagtcggcatcgagcagttgatcgccgggatccccgagctgagccaggtcgccaatgtgcgcggcgaacaggtcatgcagatcgcctctgaaagcatcaccaacgaaaacctgctgcaactgggccgccgcgtcgccgaactggccgacagcaaggacgtcgatggcatcgtcatcacccacggcaccgacaccctggaagaaaccgcgtacttcctgaacctggtggaaaagaccgacaagcccatcgtagtggtcggctccatgcgtccgggcaccgccatgtccgccgacggtatgctcaacctgtacaacgccgtcgccgtcgccggcagcaaggaagcccatggcaagggcgtgctggtcaccatgaacgacgagatccagtcgggtcgcgacgtcagcaaaatgatcaatatcaagaccgaagccttcaagagcccatggggcccgctgggcatggtggtggaaggcaaatcctactggttccgcctgccggccaagcgtcacaccctggattcggaattcgacatcaagaccatcaagagcctgcctgacgtcgaaatcgcctatggctatggcaacgtcagcgacaccgcctacaaggccctggcccagtccggcgccaaagccatcatccacgccggtaccggcaatggctcggtgtcttcccgcgtagtgccggccctgcaggagctgcgcaagaatggcgtacagatcatccgttcgtcccacgtcaatgccggcggcttcgtactgcgcaacgcggaacagcctgacgacaaatacgactgggtcgtggccaacgacctgaacccgcagaaagcccgcatcctggccatggtcgccctgaccaagacccaggacagcaaggaactgcagcggatgttctgggaatactgattggcccgcccgacctgctctggtcgggcaccgctctaccccgcactcgcccgccctgggcgagtgctccgccccggttggcctgccctcttctttatcccgcagataaaaaactcattcgttttgcagtaatccgcggatattgctgtcagaagaacctcttgaattttaagcggttgcgaaatttcctacagtaaaatactgtacgcgcatacagcttaataaggaatgttccgtgcccgccgcagcaccaccaagctcttatgaacgcctcggtttgcgcgttcagaaaatcatcaactcgcccaacgcacaaaaagccaaggccgccctgatcttccgtcagcccgacgaagcggtcgacgagtgggagcgcctgctcgaagaaatcgccgaaaacgacaacgtcaccctcgcctatcgcgatgacggcggtgtgcagattttctgggtcgtgccgaaggaagactgagtcgatgattgcccgctgttttgctgtactgctgttttgcgttgccctgaatgcccacgccgatgcgccccgtaccttcaacgaagcgaagaaaatcgcctggaagctgtacgccccgcaatccaccgagttctactgtggttgcaagtacagcggcaatcgggtcaacctcgccgcctgcggctatgtcccccgcaaaaacgccaatcgcgccgcgcgcatcgaatgggagcacatcgttcccgcctggcagatcggccatcagcgtcaatgctggcagcaaggcgggcgcaagaactgcacacgccacgacccgatttatcaacgcgccgaagccgacctgcacaacctggtgccgagcatcggcgaggtcaatggcgaccgtaacaacttcagcttcggctggctgccggcgcggtccggccagtacggttcgtgcctgactcaggtcgacttcaaggccaagaaggtcatgccgcgcccatccattcgcggcatgatcgcccggacctatttctatatgagcaagcagtacaacctgcgcctgtcgaaacaggaccgccagttgtacgaagcctggaacaagacctatccggtacaaccctgggagcgccagcgcaatcagagcgtggcttgtgtgatggggcgtggcaacgagttcgtcggcccggtcaacctgaaggcctgcagctgatatccgtccgggttgccgattaacgtctggggcatggatggccccctcaaggatgattgagcgccggcaagactggccttgacccggcacccaaaagaacggcttattgcgcgacgcagtgctcgatcacctgcggctcgatattgcgcttcttggccttggtcagcttctcgaccagctcggttttcttggcttcggcttcggcctgggaatcgaacgggccgatcagcacccgatccttgccatcttcgacgacaacataggaaatgatcccgtgttcgatcagccagccggccagatcgctcgtcgcctgaggcagggtgccggcgaccagcacatcccattgcggtttcgtggcggcctgcggcggctgtgcctggacaaccggcaccaccttcttgtccacctcgacatgcttgccttcaccgcatcccgccaatgccaggaccgccatcatcatcgctactgtgcgcacaacctaccccttgaaagtctgaggcggcgattttagcaccccaaccccctgtacaaacgccacaaaatcagcgcgaaacaaggagaatgatatttatcgcctctgtatagttgcacctcgggaattaatacagcgtctgcgcgtcagaaagaggcacccacacagtggtacttcgcagtaatctatacgcactactaccgacatctgcactgtctgaatcaggtgccctactaagcaatcaaggagaagatcatgctgatactcacccgcaaggtcggtgaaagcataaatatcggtgacgacatcacgatcaccattctgggcgttagcggccagcaagtccggatcggcatcaatgccccgaaagacgtcgcagtccatcgcgaagaaatctaccaacggatccaagccggcctcaccgccccggacaaacgcgaaacaccttgagcgtcatgagcagccagccctttgtctcatcacaatggctggcgcagcgtcatcgttgattgattccccgcagcaccctccccctcttcaaatggcagcggcgcagttcaggccgccagcgccagccctggcaaaagcgcactacccaagcccttcactgatagcgctccatcccggcaatcggtcgatacgactcggccgggagaaagccctccctcgtttttgtataaatactcagtagcgtggcaatgagcaggaggagtaatttcaagacctaccgcctccgcgaacccgccgagcccccccccccttgccatcggcagatgctttacgaacaaggagtggtcatatgcaagagttcgcttaccttctgatcaccaacgacctgaatgcgatacggaccattgccgcctgctcgacggaggggctctacgaagtcaaacgcggaatattcaccttccgctccgaggccaacgtcgactacctgcaccgcgtgctggctatcgtcagcgacgagttcggcatcattcccgtgcagcaggccgagttcaaaaccaaccgggccaccatcagcaaggctttcagccaactctgctagagcgcgcggtgctcgatgacgcgcagcagcccgcagcaagcccaaggacacgcgactcctcacctcatgactggccgagcatgaccccacgcgccatgccactggccgccactactatcagcacaatcagcagcgcctgcaggtggctgatgcgtgcaaacagcgtggcgcggccggtatcgatcgacgccccgcgccccagggcgattcgccatttgatcagcacaaccattggccatatttcgagcaacaggatgatgacgaacaaggtcatcttgatatgaaacagcggctggtgcaggtagtaatccgtgcctttttcgtaaccagcgaaggcgcgcagcaagccggtgatcaacaacaccgcggcggccagcccccagccattgtcggccagcagagcccggcgcacgtccgccccctcggtgaccacgcggcgcaacgctgtaccgcgattgagcaccgccgcaaaggcgacagcaaaggccaacaggtgtacggccgcgagaaaccagtgcatgagcatcgctccactctccattgacggatgacaaaaaacggcctgtgagtattagcccataacccgcagctttgccttgcccgacactcaataaaaaaggcgcccgtcatcggggcgcctctgtactgctcctagccgcgttcacgcacgacgctgaaccgccaccttggcccaaagggtgaaggcgacatccggagtccagccggcattcgaggtgtgctcttgcaagcacagatacagattgccctgataagtcacaccatcatctttgcgatagtgatgattcaactgccattccgggtattgcgggtcaggcaccccgccggcggtcttgatgttcaggttggtactgggcagcgactgattgccctgggcgtccgtggcgctgacaaagtagctgtacagcgtatcggttttcagcccctcgtccttcaaggtcagcgaggccgtctgggccaccggcttgccatcgcgaaacagggtgtagaactcgatcggacgaacaccgtgggcagcactccagctcaaggtcacgctgttctctgtctgtgcgggggaaaacaggttgcccggcgccgaaggtcgctcctcgccgctgccgccatggatcagcggcgcataacgatcacggaactcccagttgtaacggacgccgtacttgttgaggccgtcatcccaattgaccgaccaggtcatcaggcccttgatcgacaatccggcatgatccaggcgcttgaaggcattgctcaccgccgcagggtcgatgacatacccggtcgctgccgcgtcgacgttggccggcagaccgatcacgaacttgtcggcagggatggcgatatagccacgcgtaccggtgaccaggctttcggtcagataaaacagaaagtcttccttcagcgcgtcgttgttctgggcaatccaggcaccctgcccgccgttggcttcctggacccacagaccatcgccgccctggttgtagtattgcggcgcgatgaaatcgtagtagccatccagcgcctggatataaccgacgtatttgccgccggtggcgaggtagggaaactccggcgccatgctgatgatgaaatgcttgccctcgcctgcgtagtgatccttcaccagcttgagcgccgccggcagcacgatcttgttgtcggcaaaatcgatggcactctgctcgaggtcgatgtccagcccgtcgaaaccataggtttccaccagacggatgatttcgtgggccaacgcttgctcgttgcccttgtgcaactcgatatgagcgtccgcaccgccaagggaaatcaacaccgcccgcccctggctgttgagcacgccaacctggcgccggaactcctcgtccgacaggttgtagggcttgaaggtgggaatgccgttgcccttcatgaaggctaccgccaccacgttgtattccttgggtacatcgaccaggtcgaggttggcgaactgcccctgctggtagccgtcactggggcctgccggccagttgtgccagaagcccatgagaatcttcttgcctgcgatcgacggcatcaacgatgccgaatcattcgcctgagtctttaccgctgcaaagttgatcttgttcacgttctaatccttcagagccatttaaagagaatgacaacttctgctgttattcgaagtcgactatttgaagtcgacgtcgaacgcctgatagaacgcattgccagtgttggcgacaatccacgccagcacaatcacgtgatggcctttcttgttcttgggcagtgtcacctgatgttcgaccttggccttcatttcatcgccgtgctggtcatacggaacttgtgtatagaagtccttgaagaaagcctgcggctccagttgcgcacgactgatacgctgtttcgggtcccagccatctttggtgatgaaccagctgtaaccgcgggtcacatgaggagcggtgtactcccacttgacctggaacacctgccccggatcgacgttgagcaacggccaggagaacgaacgcccaagcttcttcgacatttcttcattggtgaagttgaggcagtcacgctcgtcggtcttgccgccgctgaggatatacccatcagccggtggcacaacgctggcgacgtcgctctcgtatggcttcggaaaaggtccgcccaccagggccgggaaatttttaccgccttccatctcattgacctgccaggtgccgagcagccccagctcgacggcgacagcgccacggctggagggggatacgacacgcccgtgtttcggttgaactaatggcttattcattattgttcactcctttgtttaaataaatctccttcttgaggagaacttttaaactagtccaaaccagtgttttgtctactgattcgcgcatacaaaatgccgagcaaattgtcgcacctcaacaaagccgggacatcaaccaataattacagcgcaaacctacagggagaaaggcaaataacttacacaagcaactaaatgaatattcaactagcctcttgtcaaccaacccttcaggaaaaacaatggagatattcaataaaccataaacccggcaagagccgggttcatgatctgtttactggataaggttcagaaaggaattacaggcaagtcgccaatgcggccagtctacgcttggcgacccagttgtcctggaccgcgtaataattgacggtggtacccgaagcctgcccccgaatatcggcaaaggactccaccgaacgggtatagaccgtgtatccacccaccttggcagattccagataggccgacacatccacaccgaacacagcttcgtcctgccaggcaaactgcacacactgcgccacgatttgctccgccttggccgacgagagcaccttgtaggggctcttcgaacgcgcctcattcatcgccgagccggcacaccccgccagcaacaccacgaccattaccgccatcaacacccgcatcacgctacctcgccgtaaaaacgcgactgtatcactcacatgacaagccattggcactcggctgcgagaaaacctctcgcagaccatttcgcgcactggccggaaaaacaaaaacccgcgcaaggcgggcttcttcatgaatcgataacacctcggttaaaggcggcgtaaaaacgagctcacaatactcttggtggcggccgttgcatccagctcgctggcagccccataggcatgccaagtgatggccgcaatttcattcaagggccgggcatcctcggcattggccacggcaacctcgaatacgtgatgccgtacattgccggcgtcgaactccaggatgtaaagaggctcactggcatccaggcctgtctcttcccgcaactcacgtatcgcggcggcagcgggagactccccaggctccaccttgccgcccggtaaagaccattttgcgcgatccttgcggacaaaaagaatttgccctccgtgcgcacaaattaccgtcgctctactcttcatacctgcaccctacccgaccacatcctgcccgtattgcgcagggaacgtgcatacagaccgaaaaccgacttaaaagtgtcacaaaaatgtcatgaaatgcataagcattaaggatgccaaaaagacaacggcatagcctggaacaaaacccacccatacagacgtagacattcacttcaaataaaaactgcatgcatctctataggtatccgtgcactccaggattgttgatgaggagaagtctcgagactctttccatgacaacgagtttccaatccacatgacctgtttgtaatgaccgctgagatcaagatgcatattcaaatatcggccaccggaggtcacatagatacagctatttataaagccaactttatcgacaccttggtgagtcaatacaaaatagcttttctcgaagttggtaacagcttccatggcaccgtcaaccagcacacctgtccattcaacaccttcacttttagctggcgcgctaaaaatccccatcacgcccttgatatctcgcggcgaaggacatgattcctgatcacccggccagtcagggatattgaggtcattgctaccaggcgcagcatgcacgaatgtaaatagctgcgaacacagcaacacccaacccaacaatctagacacgttccattccttcgtaaatatcagaaggaaggttctatcaactagaacaactttagaatgtaggacgattcctaaaatattagttttttctcttaagcccagcagtctctccatcgaagcgcccgctcttggtggtcagttgcaaagtgcagtcacaacgacgcccctgacttaagcgtgctatccacctggaccagaccagcctccaacgccgcgaaaatctccagcttgaagtcatcggtggaccttgaaagaacactatcaggaagggcatgccgaaaaagagatcgtgtacctggaagcaggtgccgacttggccttttgagtggcggcttcgcaaaggttttgaaaaccgcggacaacaaaaaagggcccacctttcggtgggcccttctagaccgcccagcagagcggattttgtttggtaggcgcgattggactcgaaccaacgacccccaccatgtcaaggaccactgtgctaagcaccaagccatatggctcaaggccctaagagaacgcctattcacactatgaggcgtcaacaatggctaatatccgctcactaccgtcagggaactggaatgctcaggtacgattgaaaggaaaacctgctcaatctaaaacctttcctacacaagcgttggcccaagcatgggctgaccagcttgaagccgtcaccaaggaccaccaaacccacacgatttacacattgggcatgacctactgtgaaaccttgctcaagggtaagggtagctatgaccatgcaatcaagatcgttaaccagctctttgctgtgttccctcagtcaatccatgacatcacccctcagctggtcaatgacttcaagctgaagcgtctacagacggtcaagcctgctacctgtcgcatacagctagcgttcatgtctcgtttcttcaggtttgctaaacgtggcctgcttatcgacattcccaatcccgtaagtgacatagccctgcccaagccagacaaatcgagcgacaaggtaatcagtgctggcgagctaagacaattgctcaacaagctctcccccaccatggcacttatagtggagcttgcctatgaaacggctatgagacgttctgagatactcaagctcacagttaattgcctgcacctagaagaacgtattgcggatgtgattgatgggaagaacggcactagatctgtccccctgacattacgtgccatagagctattgaaagaagctcagcgactggcgctagcagaccgaacaaacaagggaaggctattcactgtgacgcctcatagcgtcacacaggccgttcgattggcaagaaataaagcgggcttggacaatagcgttaggcttcatcaattacggcataccagaatcacgaacgtagccaagaaagggtttaacaacgctcaaataatgattgtgtcaggccaccgggatactaggtccgtcgccagatattcacacctgaatgccaaggacgtgcttcatctgattgactaaccccctgtaagctcactggtgaggcgacagttcagaaccctcaccagcttatatataacaattcaatcctccctatacgagcctgtagggcgtgacagaaagcattgatagtaggtaatgagatgggcaccttcaataattaaccttagaaaatatttttatacttctttgtaggcctttcctagaaatctaggtatagataagtatgggataaacttcccaccccctactaatccaccctacaaccatgcaggacgcattcacgcgcccacaaatcggacaccacatatctcatgggggatatagggggcagccgcaccatattaacaataaccataggtagtaataatgagtatcacactagaagaaattgtagcactccaacatcagcaacttaacacactctctcgaaaaatcatttacttgatgataagaaaccaagtcaatcaagaagggtggtccactatctcaagcatggatttctgcaaagcaacggcactctctcgacgctctgtagaatccattgtaaagcaccttactaagatagcaatggtagagcgtcgcaagtcaggcactcaacactcctctccatatcaatatcgtgtaattaatccctaatcctaaggaagaaaacaatgaaaaccctaaaccgtaatgatcttatagaactatcacaagccactggtcgctccattgacgaagtaatgcagattgcccagcaatcaggctggaactattcagaggctacagaacctgctaaacgcttgcgtggccttgataatgctgctgacgcttacaccatgatgaaacaggttaaggaacaaactatctccaacctgtatcagaatgatccgctgattcgtgaaagcatcaatgctcactcagcaattgaacaagcacgcactagtcaagaaacaagcaaacccaccaatctaatctatgacgagcatgggaatttcaaaggacttaagaaaagcgttatcaatggtatacacgccactggcaagcatcaaaccgacgcaatgaaagcaatcaagacggatatctacaaacgatttggagtggacgaatgactgcgcactatatgtctgatggagagcgtcagtatcttgagaagcgtaaagctgaatcagcagccctggctctcctcattgaaaccaagaacagcagattggtaggagatgttaagacttacaagggcattaactatcagatggaaccaaggggcacatacgtatgccttaatcttccgtctcttagcgagctagaaggctcattcacttctgcctttgctctacataagatcatcgacgacatggaaagactgaagaagcttcctaaaacagggaagtgaaactactcattagctggctgactacagccttcatcgtatacgccttatgtctaaccttactaacactcgccaaactagtcattagcgccacctcctacatcatttaataaggaataaatatggcttcagatgaagactttattctagtgcccaacctcattcccaatacacgatttttgagacctatagccatcaaacgatggatagcaaaagaactggtagcagcaaaaggtaacagccaggccatttataaactttcattacaatacagagttcctctccaggccgctagctatatatccaacctggagctagcagagatagaacggtcaatcaaatacaaataaggatattatggatcctaagacaatatttatagcagagtcccttcccggtagtggaaaatctacaaagttcattgaggcactacctacacttatacacaccagcaagattgtgtatgcaatgcctacgaacgcgcttatcagagagcttgaactgagtatcaaaaccaacgttggcatctcaccaacagtcatcacatctgaaactgtggatcatgtgacagcacacttagagaaagccttagctgtcaattctgtagtggtcaactaatcccggacacgacgttaagttttttctcggcccgagctggcgctagtccgccgttgaattggtgtggtcgaatccagttgtaccgatgcatcaaataatggctgatgtcccggtgcgcttcttgggttgtcatgtagccctcagtcggtatccattcagttttcaggctgcgaaacacgcgttccatcggcgcattatcccagcagtttccccggcggctcatgctctggcgcatgcggtaacgccagagccgttggcgaaactgacggcttccatattgcgacccctgatccgagtggaacagcaggccttgaggcctgccacgctgttcgtaagccatgtccaacgccttgataaccagatccgcatccggcttgttcgacagcgcccaacccacaattcgacgcgcgtagagatctagaacgaccgccaggtaatgccatttcccctgcgcccagatgtaggtgatgtcgccacaccagacctgattgggtaccgatacctcaaactcccggttcagggtgttcggaatatcaggacgctcgaccgtcgcttgtttataggcatgtgagccaggttgtttgctgactagttccagttctcgcatcaagccacgtaccttgaaccgcccgatttgctcgccatcttcctgcatcatcgacacgatactgcggctgccggcagcgctgcgactttgcgtgaacagttcgttgactcgactgcgtaatcgaagtcgttcaacgttcggagttcgacgtctgaggcggtgggcgtagtagcacgaacgagtgatttcaaagactgtgcaaagccaatcaaccggctcttgtgcactcaactgatcaatcagcgcgtgcgctcgtgttcttccgacatcaagagcgccgtagccttttttaaaatggatttctcccgctcaaggcgagcaattcgagcttccagttcctggattttttgctgttcaggcgtcagcgccttgctctgcggagtaacgccggtgcgctcctgctgaagctgattaacccagcgacgcaacgcggactcgacaaccccgagtgaacggcaggcttcgatatggctatagccttgatcgagcacgaggcctgcggcctcgcgtttgaactcagcggaaaaggaacgacgttgcttggtcatcagacacctctatctggcgagcattctcgcctaaatgggtgtccggtttcattagaccactacattgacactatagcagtaagctagacctaggaattttggctagaaattcattagcaccaatgcatacataagcagccctccccacccccccgctctccccctcgacctgctgacctacaacctcaaacgatgggcatagccgtgtcagtaaaactcaacacagggggtttggtagcgttcatgccgataggcgctgaggaatgcaggcacgtagctcagttggttagctagcctgcccttgtgaggcacgaacaatgggcaagggagtgagcttgcgaacgtaccaccacctagacaagaaagtgctcagaccatacgtatcaagaggttagggagagtcgttcacaattgtttgtgtgaacagaggcaaggcatgaatgcacgttcacattgccttgtgtgaacggagcctatagtttgtgaacgttttcttaggcaaagaaaaaggggaaccctttcggattccccctcacaccgcccagcagagcggattttgtttggtaggcgcgattggactcgaaccaacgacccccaccatgtcaaggtggtgctctaaccaactgagctacgtgcctgctgtgaggcggcattctacggaattccggaggggtgtcaacaccttttttgcagctaaccctctgaatatgcgaatttttattttttgagcctgccaagaagagttttcgatggctggtaggcgtttttcaactcaggtaggatccacgcaatcgtcaagaatattaaacagaagttgcaggatggcgaacacaccttacccacagtcgtattacgcggcgtcagccaacgctgctccagcccgcccgctgctgcaagatgatgtggaaaccgatgtctgcgtgatcggtgctggctataccggcctctccagcgccctgttcctgcttgagaatggttttaaagtcactgtcctggaagcggccaaggtaggtttcggcgcttccgggcgcaacggtggacagatcgtcaatagctatagccgtgacattgatgtgattgaacgcagtgtcggccccaagcaagctcaactgcttggccagatggcctttgaaggcggcaggatcatccgtgagcgggtcgccaagtatcaaatccagtgcgacctgaaggatggcggagtgttcgccgccatcaccagcaagcaaatgggtcacctggagtcgcagaagcgcctgtgggagcgctacggccacacccagctggaattgctggatcagcgccgcattcgcgaagtcgtcgcttgtgacctgtaccagggcggcatgctcgacatgagcggcgggcatatccacccactcaatctggcactgggtgaagcggcagccgtggaatccctgggtggcattatctacgagcagtccccggcggtacgcatcgaacgcggtgccaatccggtgatacatacccctcaaggcaaggtcagggccaagttcgtcatagtcgcgggcaacgcctacctgggcaacctggtgccggagctggccgccaagtcaatgccgtgcggcacccaggtcatcaccactgaaccattgagcgatgagctagcaaaaagtctgcttccccaggactactgcgtcgaggactgcaactatctgctggattactaccgtctttccgccgacaagcgccttatctttggcggcggcgtagtctacggcgctcgcgacccggcaaatatcgaagccatcatccgaccgaagatgctcaaggccttcccgcaactcaaggatgtgaagatcgactacgcctggaccggcaacttcctgctgaccctgtcgcgcctaccgcaagtcggacgcctgggcgataacatctactattcccaaggctgcagcggacatggcgtcacctacacccatctggcgggcaaggtactggcagaggccctgcgcggccaggcagaacgttttgacgcctttgccgagctgccgcactacccctttcctggcggccagctgttgcgcaccccatttaccgcaatgggcgcctggtactacagcctgcgggacaagctggggttctgataaccctgcctctctacaaataaaaaaccgcccataaggcggttttttatttgcagaaaggcaatatcgactgactgagcagtatcgaaaaagccggattccgaaaacaaaaaaccccggtctttcgaccagggtctttgctatcgatccgaagagcttgcggcttcttcgtcacctgagggcgttcagtgttccctcaagtagatatggcgcagcggacgggactcgaacccgcgacccccggcgtgacaggccggtattctaaccgactgaactaccgctgcgtatcgcttggacttgcgtccatgtgaaccgtttaaatcgtctgactggaaagcttcgaggcttttcaatctcagagcaggaatccctgatctggaaaatatggcgcagcggacgggactcgaacccgcgacccccggcgtgacaggccggtattctaaccgactgaactaccgctgcgcgtcggttggatgcttccgtggaagcctccgcctttctttcgaaagacactcaagaagtggtgggtgatgacgggatcgaaccgccgaccctctgcttgtaaggcagatgctctcccggctgagctaatcaccctttgcttcgttgaggccgcgaaatttacgcagataccgatgctaagtcaataccctgcttgaagtttttctgaaaaagacaaaatcacgacaatgcctgcagaagggatcaacaacaccggcgacctcaagccgtgctcgttgcgccctccacacgccatcagtcgcgataaatcatttttttgctcataccgccgtcgaccacgaactcctgaccagtgacaaaaccggagttcttcgacaacagccacgccaccatcgccgccacatcttcgaccgtccctaccctgcccgccggatgctgggcatgatcggcatcgctcaggggctcggcccgacgcgccgccgggtcccgagcgtcgatccagccggggctgaccgcattgacccggatctccggccccaggctcatggccaatgcatgagtcaaggccagcaaaccgcccttgctcgccgcataggcttcagtgtccggttccgattgccgggcacgggtagatgccaggttgacgatggctccgccatgagcacgcaaatacggcgcacagtgcttggccaggagcatcggaccgctgaggttcaccgccagcacccgattccagtaagccaggtcgaggctctccagggtgatgttgcgcggatcggcgactgctgcgttacacaccagcgcatcgaggcgcccgaactgccccagcacttcggcgacacccagggcgacctgcgcttcatccgccacatccatgccaatgaaccaggcactgtcacccaggaccttggccacctgggagccgcgtacccgatccagatcggtcagcaccacctgccagccttcgctgatcagccaggcagcgatgcccaggccgataccgcgtgccgcgccagtcaccagcgcgacgcggccgttggcaatgctctgctgttcggacaactcgatcacaaggctgccaacccacgcgccaggtcggtttgcaggtccaccacatcctcaaggccgacagcgatgcgaatcaggctgtcacgaatgcccgccgcttcacgctcttgcggcgccagacggccgtgagaggtggtgctcggatgagtgatggtggtcttgctatcgcccaggttggcggtaatggaaatcaggcgagtggcgtcgataaaacgccaggccccgtccttgccgcccttgacctcaaagctcaccaccgcgccgaaaccacgttgctgacgcttggccagttcgtattgcggatggcttggcagaccggcgtagtgcaccctctcgatgccgtcctgctgctccagccattcggccagggcctgggcattggcacaatgggcgcgcatccgcaggttgagggtttcgaggcccttgaggaagatccaggcgttgaacggactcagggtcggtcccgcggtacgcaggaaacccaccacttctttcatctgttcgctgcggccagccaccacaccgcccatgcaacgcccctggccatcgatgaacttggtcgccgagtgcaccaccacgtccgctcccagcttcagcggctgctgcaacgccggggtacagaaacagttatcgaccaccagcatcgcgcccttggcgtgagcgatttcggacaacgcagcgatatccaccagttcggcgagcgggttggacggcgattcaacgaacagcaacttggtattggtcttgatcgccgcatcccaaccggacaggtccgccaggggcacgtaatcgacctcgataccgaagcgcttgaaatacttttcgaacaggctgatggtcgagccaaacacactgcgcgaaaccaatacatggtcgcccgcgctgcacaaactcatgaccaccgagagaatcgccgccatgccagtggccgtggccaccgcctgctcggcgccttccagggcggcgatgcgctcttcgaacgcccgcacggtcgggttggtgtagcgggaatagacattgcccggcacctcgccagcgaaccgcgcggccgcatcggcggccgtgcggaacacgtagctggaggtgaagaacatcggatcgccgtgctccccttccggggtacggtgttggccggcgcgcacggccagggtgtcgaaagctacgccatcaaggtcgctgtccagccgaccggcatcccaatcctgactcatgccgcctactccttatgtcttctaatgctctaaatcagttgttgtacagatcgatgatcgcactgaccgcctgggtcttggccttggaggcatcgttacgtgcgttttcgatcttgttcaggtaggcctcatcgacgtcgccagtgacatatttgccgtcgaacaccgcgcagtcgaagttctcgatcttgatcttgccgccaccgaccgcctcgatcagatcaggcagatcctggtagatcagccagtcggcgccgatcagatcggccacatcctgagtcgaacgattgtgcgcgatcagttcgtgagcgctcggcatgtcgatgccgtacacgttcgggaaacgcacggcaggcgccgcggagcagaagtagacgttcttcgcgccggcttcacgggccatctggatgatctgcttgcaggtggtgccacgaacgatcgagtcatccaccagcatcacgttcttgccgcggaactccagctcgatggcattgagtttctggcgcacggattttttccgcgcagcctggcccggcatgatgaaggtccggccgatgtagcggttcttcacgaaaccttcgcggaacttgacgcccaagtggttcgccagctccagcgccgcggtacggctggtatccggaatcgggatgaccacatcgatatcgtgatccggacgctcgcgcaggatcttctcggccagcttctcgcccatgcgcaggcgcgccttgtacaccgacacgccgtcgatgatcgagtccggacgcgccaggtagacgtgttcgaaaatgcacggagtcagcttcggattggtcgcacactgacgggtgtgcagcttgccgtcttcagtgatgtagaccgcttcacccggcgccaggtcgcgaatcagggtgaagcccagcacatccagggacacgctttcggaggcgatcatgtattccacgccttcgtcggtgtggcgctgaccgaaaacgatcgggcgaataccgtgaggatcgcggaagccaacgatgccataaccggtgaccatggcgactaccgcataaccgccaacgcaacggttgtgcacgtcggtcacggcggcgaacacgtcttcttcggtcggttgcagcttgccgcgctgggccagctcatgagcgaagacgttgagcaggacttccgaatcggaattggtgttgacgtggcgcaagtcagattcgtagatctccttggccagctgttcaacattggtcaggttaccgttatgcgccagggtgatgccgtaaggcgagttgacgtaaaacggctgagcttcggccgaagtcgagctgccagcggtcggataccgcacatggccgatacccatgtgaccgaccaagcgctgcatgtgccgttgatggaaaacgtcacggaccaggccgttgtccttgcgcaggaataaccggccatcatggctggtcacgataccggcagcgtcctggccgcggtgctggaggacggttagcgcgtcatacagcgcctgattgacgttcgacttaccgacgataccgacgatgccacacatgcgacgcaacccctacttaatgaaactgaactgaacacatcttactgaggcgttttggccggtaagagttgttccttgaacggtatttcagcgggtacgctgataccgctggccagccactgactgctccaccccaatatgaggttttttgaccagtctgcaaccaatagaaattgtggcaccagtcgcgactgctgccaccaggaatcctgttgtaccggccccaggctcaatagcccgaccgccacgaccaccagcaacgcgccacgcgccgcgccgaaggccatgcccaggaatcgatcggtcccggatagcccggtgacgcgaaccaattcgccgataagataattgatcattgcgcccacgattaaagtggcgacaaacatgatggcacagcccgcgatcacgcgagccgagggagtctcgatgtatccgctgaggtattcggacagagagccaccaaacatccaggcaacgactcctgcgacgatccaggtaagcagcgacagcgcttctttgacgaagccgcggctcaaactgatcaaagcggagatggcgatgattgcaacgatcgcccagtcaacccaggtaaatggcacagtgcagcctacagacggataaggcggcgcattttaacagagcgcatggccgtcggtaagctgcgattcactgtgctttgcaaatcaaggcgatagcgttaaccgcgctcaggctggaagcgcacgacaaaacccttgaggttctgctgacggctcagcaaatcgcgcaggcggtctgcctcggcccgctcgatcaatggaccgacgaatacccggttcttgccatcggcggaacggatataagcgttgtacccctggctgcgcagggttttctgcaggttctcggcgctttcccgactggacaggctggccagttgcaccgaccaactgaccgacaggccgtttgcatcgacacggcttggggtcgcatcgggcttggctggcgctgcggcaatcggctgggccggagccggcttgggggctggcgctggaggtggagtcacgggcttgctcgcggcgactggcggtgccaccgggactggagccggagcaaccggagcgcttggcgcaatcggcatcgaaggcgcggcctgctgggccacttcttcatcggtgggtaccggctcctgtggcagcgcctgcggctcgggcaccaccacaggctcgacttgcacctgggttacagcaggcgcctgaggcactgctggcgcctcgacattgatatgccgctgctcatcttcgcgggaaaacagcatcggcaggaaaatcaccgccaacgccaccagaaccaaagccccaaccattcgctgcttgtagacgttatccagcatagccatgtgcagcttcctccgtggagcgccgagcgagccactcgagcgcttcggcaacacaataaaaagatccgaacagcagaatctcgtcttcggccgtagcctgcgcacactgcccttccaaggctgcggcgacactctcataagacgttaccgaagccccaaggttctgcagtgccgcctgcaagtccgcaacgggacgcgcacgggcagaatccagcggcgccaccgcccaatgctcgacacaggcatccaggcgggcaaccacgccctccagatccttgtccgccaacaggccgaataccgccaggcgcttgcccgccactggtcggcgcatcaggcgctcggccagatactccgcggcatgggggttgtgcccgacatccagcaacaggttcaggcgcttgccctgccattcgaattgacggcgatccaggcgcccgaccactcgcgtctgctgcaaggcttcggcgatgcgttcggcctgccaaggcagccccagcaacaaataggcctgcaaggccagcgcggcgttctccatgggcagatcgagcagcggcaagtcgcgcagctcgacagcattgccccgcgcatcgagcccccgccactgccagttcgcctcggtgatccccaggtcgaaatcacgaccgcgcaggaagaacgggcagttcaattcacgcgccttatccagcaagggctgagggggattcaggtcaccgcagagcgcaggcgcgccctgacggaaaatcccggccttctcgaaggccacggactcacgggtgtcacccaggtaatcggcatggtcgacgccgatactggtgaccagcgccagatccgcatccaccaggttgaccgcatccaggcgcccacccaggccgacttccagcaccacggcatcgagaccggcacgctggaacagccagaaggccgccagggtacccatctcgaaataggtcagggaaatttcaccgcgcccggcttcgaccgcgacaaaggcctcgcacagttcggcatcgctggcttcgacgccatcgatctgcacgcgctcgttgtagcgcaacagatggggggaattgtagacaccgaccttcagcccctgggctcgcagcaaggacgccacgaacgcacaggtagaacccttgccgttggtaccggtcaccgtgacgacccgaggcgccagcctgcccaatcccatgcgggacgctacttcttgcgagcgctccagccccatgtcgatggctgacggatgcaactgctcaaggtaggcaagccagtcgccaagggtacggtcggtcatatgtttgcaggcaccggtggcaccacgatcgcctcgacgggcgcggccacgaactcaggcgtcggcaagcccatcagttgagccagcaggttacccagacgcggacgcagctcctggcgcgggatgatcatgtcgatagcgccatgctccagcaggaactcgctacgctggaaaccttccggcagtttttcacgcacggtctgctcgatcacgcgagggccggcgaaaccgaccagggccttgggttcggcgacaatcacgtcacccagcatcgccaggctggcggaaacgccaccgtagaccgggtcggtcaacacggaaatgaatggcaggccttcttcacgcaggcgcgccagcaccgcggaggtcttggccatttgcatcagggagatcagcgcttcctgcatccgtgcaccgccggaagcggagaagcagaccatcgggcaacgcttttccaacgcgtagttggcagcgcgcacaaaacgctcgccaacgatggcgcccatggagccgcccatgaaggagaactcgaacgccgataccaccaccggcatccccagcagggtaccgctcatggaaatcagcgcatccttttcaccggtctgcttctgggccgcggtgaggcgatccttgtacttcttgccgtcgcggaatttcagacggtctaccggctccaggtcggcgcccagttcggcacggccctcagcgtcgaggaaaatgtcgatacgggcgcgagcgccgatacgcatgtggtggttgcacttggggcagacgtccagggtcttttccagctccggacgatacagcaccgcctcgcaggacgggcacttgtgccacagaccttcaggcaccgagcttttcttcacctcggaacgcatgatcgaagggatcagtttgtctactaaccagttgctcatgctttctttctccagtaccggcggcccgaacgctctggttcgcggccccgcgtatgcccttgagctaaattcatgtgtgcggcgatgatctgttcgctaccgcggtcagcgcgagcttgacctgcctgtaccgaacggctcctcagccatcccggcaacccccggatagagcggctgccacttcgatttcggcccgcccagcgacggtgccggcctgttttgtacagtggtgttatggacggcggcagactgccagccgtcacatcgactaacagctgccgcgaacggcctgcataaatgcgcgaatctttgcgtgatccttgatgcccttgctctgctccaccccgccgctgacatccacggcgtacgggcgaacctgcactatcgcctggccgacattctcggcagtcaagccaccggccaggataatcggcttgctcaagccttgcggtaccagtgaccaatcgaaggcttcgccggttccacccggtacgccctcgacataggtatcgagcaggatgccgctggcccgcgcataagccgcgcaacggctggcaatatcgtcgccggccttgacccgcagcgccttgatgtagggccggtgatagccctcgcagtccgccggcgtttcatcgccgtgaaactgcaacaggtccagcggcaccgcatcgaggatctcgcccagctcgcagcggctggcatgacgaacaggcccacggtggtcacgaacggcggcagcgcggcaatgatcgcccgcgcctgctgtacgctcaccgcccgcgggctcttggcgtagaacaccagcccgatggcatcggccccggcctcaaccgccgccaacgcatcctcaatgcgggtaatcccacaaattttgctgcgaacggctgacatgtcgtttaaacctcagggcaaatccggggaaagtcccggatggtagcaaatgcttttccgggcgtcagccgtcaagttccgagaagccggtgaggaaatgtggcccgatgtatcgctcgggcagctcgaactcatcgtgatactcgacctgcaccagatacagtccgaaaggatgcgccgtcaccccgcccgtgcggcgaatccggctctccagcacttccctggcccactcgaccggacgctcgcccgcgccgatggtcatcagcactccggcgatattgcgcaccatgtgatgcaggaacgcgctggcgcggatatccaggacaatcatcttgccgtgccgggtgacccgcagatggtggatttccttgatcggcgacttggcctggcactgccctgcccgaaatgcactgaaatcatgggtgcccaccagatgctgggcagcctcggccatccgctcgacatccagcggccggtgattccaggtgatctcctcgttcaagtgcgccggacggatctggtcgttgtagatcacgtagcgatagcggcgggcaatcgccttgaaccgcgcatgaaaatgcgccggcatgaccttggcccagctcacgctgatgtcgtggggcaggttgatattggcccccatcacccacgccttcatcgaacgctcggcctgggtatcgaagtgcaccacctgcccgcaggcgtgtacgccggcgtcggtacgtccggcgcaagacagcagcaccggcgagtccgccacccgggacaacgccttctcgagggtttcctggacactcgggacaccggaagcctgacgctgccagccgcgataacgcgagcccttgtattcgacacccaacgcgattctgaaaaagcctgcggccgccatttcggcggccgcgttatctatatttgccaagaacttacagcctgctgatatgcgcaaaggcagccattataaggcgcgcgcaagcagacgccatgcgcggcccgcttttagttgatgtttgcccattaagcgccagcgagcgtaaacaggattgcgtgaaaaccaggacaaacgctatatagacaagtacatagcgacaagcataaatccactcgaccgggacctgaccaatgaccgccatcaacaaggaggccgtgggcctcgcctacagcctgcaaggtatgctccacgccaagcgcaagacctgggaagccatcgcgcagatagccgcgcgcatccagccaggcatgctcgaatcccaggctcgcgccttggggctggaggtgcttgcggaattgggcatggaccggatctggcacccggcgctggtgcgctttggcgaaaacaccctgaagaccttcaagcaacgctccgaaggcgatccgatactgggcgacaacgacatcttctttatcgacctgggggtggtctgggaccgccacgaaggcgattgcggcgccaccttcgtcaccggcaacgatcccgagatgcaagcctgcgctgcggcagcccaaaccctgttcgaacgggttcgcgatcactggaacgagcaccaggtggccggccctgccctgtatcgctatgccgaaaaacaggcgagtgccatgggctgggtgctgaaccttgagatcaaggggcaccgggtcagcgacttcccccatgccatttatcgagcaggcgacctgggcaacttcgaggcatgccccaacgtcggcctgtggattctggaaatccagatcgcccaccctacccggccattcggcgccttctacgaagacctgctggcttaaccgcgcaagcgctgccatgggcccagaaacaaaaacggcagcctcgatggctgccgttttttgctgctagcgtcgactcaggccagacgcgcgagcatttccttggcttcgcttttctgaccgtcgttaccttcgctgatgacttcgccgagaatatcccgcgcgccatcgttatcgcccatgtcgatgtaggcctgggccagatcgagcttggtcgccacttcatcggcgccggaaaggaaatcgaaatccccttcgtcggcactgcccgcggcgtcttccgcggtaaaggtcggctcggccaggtccggctgctcgaggctctgcgacaagcgatccagctcggcgttgacatcgtccagctcggaagcgaaagcatccttggcagcgggctgcgcatccatctcgtcagccagtgacaagtcgaagtccgcgggcagctcaagatcgtcgagcgcagcttcggtcaccgtaggcacttcgacagccggcagatccttcagatcgtcatccaggctgagcagaaaatcctcatcggcttgcgccgctgcaggaagatcctcacccagatccaggtcgaaatccgacagatcatccaggctttccttggcttcggtttgctgctgcagcaccgactcgaagctcaggtcgtcatccagcgggaagtcgtccagctcaggctcaacttgagcaggaacagccggagcaactggcgccgctggagaggctgcctccagatcgtccaggctcagatcgaagtcggtatccaggtcgtcgacagccggtgccggcgctggctcctgcggctcgtcgagcaacagttccttgacgtactgagcatccagcgccgccgctgcggccgcagcgccgagacccgcggccgccaccgcagccattgccgggaagcgacttttcagctgttcgacttcagcgtgattcttgccattggccaccagctgacgctcctgggccacaaaggcgctgcgatcgccctgatgaccgtagacttccatcagcttcaagcgcaactcgctacgctgcggctccagcttgaccgcctcctccaggatcgccgccgcctggttcaggcggccgccatcgatatgggactgggcctgatccagcacatcggccggatgctcgactgcggcagccaccggcgccgcgtccaccacaggcaccacgaccggggctggagctggagctggagctggagctggagcgagcttgacgctcggcggtggaacttcaaggccttcgaagctgctttccggcagatccagatccttggacagctcagactcttcggacagggcgcgagccatgcgcagatgcttttccgcctcctgccgagccttgcgacggcgagccagcaacagcagcaacaacagcaccagcactgccccgccgcccgccagccccaggaggatcggattggtcagcaggtcgttgaatttgtcctcatcggacgccggtgtttgcgcctgggccggtgccgcttcagccggggcctcgcccgacgttgccgcaggatcggccactggcgccgccggggtcgcaggctgctcggccagttgcgccggcatggccgcggtcggttgtgctggcgccacggtacccgccccttgcgcctgcaatttggccaactgtcgttcttcaattcgatcaggcgttgcagcttgtccagctggctttgcaggtccgtcagacggcttttcagctcggcgttgtcacgccgggccgtatcgaggctttcctgagtcaccgccagcttgttgctcagcgcctggctgtcgccagccgcgcccttgccccgcgccttgcccgactcggcagacaccaggctcagattatccttggccgcgccttgtgcaggcgccttgtccgcgcccccgcgccgggtgccatccagttgctgctgagcgccacgcggcgccaggcggcgcccctgacgccacaccgtattctgcgcggcgacctcggcgatcgcttgcggctgcggcaggctggtgctctgcacggcatcgggcaggcgcaatacctgcccggttttcagccggttgatgttgccgtcgataaaggcatccggattcagcgcctggatagccagcatggtttgctggaccgaaccgccattgcgggccttggccgcaatttcccagagggtgtcgcgggccgaggtggtgtattgagcaggcttgccggcaccggtgaccggcgcggcaaccgctggagcctgtgccgcgggttgcgcggccgcttcagcggtttgcggggaaaacttggaaggatcgagcagaacgctgtagtcgcgcagcagacggccattgggccacatcacctgcaccaggaacttgaccatcggctcggagagcggctggctcgacgtgacccgcagcacgctcttgccgttggcattgagcaccggcgtaaagctcaggtcattgagaaaggcctggcgatcgacgcccgccttggcgaaatcttcaggcgaggccaggctcggcaccacctcggcggcggtgagatccttgacgtccagcaactcgatttctgcaaccagtggctggttcagagtcgacttcagggtcagctccccgagcccaagcgcctgcgccataccggaggacagcgccgacgcggccgctattgctaacaccagtttgcgaacttgaaccatagcctcatcctttgtttgaacattcctcggccagcgagaaggtgttgtagcgctgccgtaaggcattgcgtgcggcctgaagggccgcttcgcgcgatatatgtctgcatgccttggaagagcgcgacgacagctcacctccagcaaccagccaagcatagcgcccagctagaatcattctgcaaattgttgccaagtatcttttacagaaggtcttttatcaacaactcagccagctgcacggcgttgagcgcagcccctttgcgtacgttatctgacgtcagccagagattaagttccgccgggtcgtcgatccccgcgcgcacccgaccaacgtagaccacatcctgccccaccgcatcgcccaccgcggtcgggtagtcgcccgcctccaccaactcgatgccgggcgccgcttcgagcgcggcattgaccgcgtccaggtcgatcgccgtggctgactgcagagtcacgctatagctatcgccaaaaaacaccggggcttgaacacaagtgacagaaatctttaataaaggctgcgccagcacctcgcgcaactcccggaccaggcgtttttccaacaaggtgtgaccttgctcgtcgggcgtgccgacctgcgccaacaggttaaatgccatctgccggtcgaagaatcgcggctccaacggacgcacattgagcaattcggcggtctgccgcgccagctcggttaccgcttcacggccctgggtggacaccgcgaggctggcggtcaggttgacccgctggatctcgaacagggcctgcaacggcgccaggaccaccgccagcgatgtggctgcggcgctggggctgctcagttgaacaggcttttccaggccgctcagcacgcgctcgttggcttccggcaccagattcggcgcctgggccgaaggcaatgcgcccgacaggtcgatcaccgcacaattggccgccgtcgcccgtggggcgaagctcagggtcaccgcagggccggcagcgaaaaacgccagctgcaccttgctgaaatcgaactcgtcgacctcacgcacgcgcacattttttccacgaaacggcaccgagtgccccgccgattcactgctggccagcaggtgcaggttggcgatcgggaaatcgcgctcttcgagaatctggacgagggtttcgccgacagtaccggtggcaccgataacggcgatatcgaaggactggttcatggtgctacctctggcgaaacggggggagcggcactttacccggcgcttgggggcgaggcaatttatcagatctggcacatcagacttttcgcaaacatgctcatagccagcaatcaggagctgctccgagatgaaaaaagcccgcgcctcttgcaaggcgcgggctctttcaacgcatcagagcatcaacgctcgagcaggatccgcagcatgcggcgcagcggttcggcggcgccccacagcagctggtcgccgacggtgaacgcgccgaggaactgcgagcccatgttcagcttgcgcagacggcccaccgggatgttcagggtgccggtgaccttggtcgggctcagctcctgcatgctgatgtcacgctggttcggtaccagcttgacccaagggttgtgctggctgatcaacccttcgatatcggcgatcggcacgtccttgttcagcttgatggtcagcgcctggctgtggcagcgcatggcgccgatccgcacgcagatgccgtcgaccgggatcgggctcttgaagcggccgaggatcttgttggtctcggcctgggccttccactcttcgcggctctggccgttcggcagttccttgtcgatccatgggatcaggctgccggccagcggcacaccgaagttctcggtcgggtaagcatcgctgcgcatggcttcggcgaccttgcggtcgatgtcgagaatggcgctggccggattggccaggtcatccgccacggcggcgtgggtcgcccccatctgcttgatcagttcgcgcatgttctgcgcgccggcaccggaggccgcctgataggtcatggcgctcatccactccaccagaccggcttcgaacaggccgcccaggcccatcagcatcaggctgacggtgcagttgccaccgatgtagttcttggtgccggagtccagctgctggtcgatgaccttgcggttcaccgggtcgaggatgatcaccgcatcgtcctgcatgcgcaggctggaagcggcatcgatccagtagccctgccagccggcttcgcgcagcttggggaagacttcgctggtgtagtcgccgccctggcaggtcagaatcacgtcgagggtcttcagctcttcaatgctgtaagcgtccttgagcggagcaatgtccttgcccacggacgggccttggccaccgacattggaagtggtgaaaaacaccggctcgataagatcgaagtcttgctcttccagcatccgctgcatgagcacggaaccgaccataccgcgccaaccgatcagacctacacgtttcatcgcaactacacctatacaaaagtgggccaccgtctgagcggtgggcccgaaagattacagattccgcagcgcggcgactactgcatcgcccatttcctgcgtacccaccttggtgcaaccggccgaccagatgtcgccggtgcgcaatccctggtccagtaccaggctcacggcctgctcgatggcatccgctgcgtcgttcaggttgaagctgtaacgcaacatcatcgacaccgacagaatggtcgccagcgggttggcgatgccctgcccggcgatgtccggcgccgaaccgtggcatggctcgtacatgcccttgttgttggcatccagcgacgccgacggcagcatgccgatggaaccggtgagcatcgacgcttcgtcggaaagaatgtcgccgaacatgttgtcggtgaccatcacgtcgaactgcttcggcgcacgcaccaactgcatggcggcgttgtcgacgtacatgtggctcagttcgacatccgggtaatccttagccacctgctcgaccacttcgcgccacagctggctggacgccaggacgttggccttgtccaccgagcagagcttcttgccgcgcacacgggccatgtcgaagccgacccgggcgatgcggcggatttcactctcgctgtacggcagggtgtcgtaggactgacgctcgccgttttccagctcgcgggtgccacgtggcgcgccgaagtagatgccgccggtcagctcgcgaacgatgaggatgtccaggccggagacgatttccggcttgaggctggaagcatcggccagttgcggataaaggatcgccggacgcaggttgccgaacaggcccaactgcgcgcgaattttcagcaggccgcgctcagggcggatatcacgctcgatcttgtcccatttcgggccgcccacggcgcccagcaggaccgcgtcggcagcccgcgcacgatccagggtctcgtcggccagcggcacgccgtgcttgtcgatggccgcgccaccgatcacgtcatggctcagttcgaagcccaggctgtacttgtcgttggccaactccagcaccttgaccgcctcggccatgatttccgggccgataccgtcacctgggagaatcagaatctgcttgctcatgctttcctcatttgctctgtcggtgtgctggttggcacgcccggaaaaatgctgttgcctggcctgcggcgtccgctcacccgtagagaacgaagcgctggcccgaatatcaagccgccatggctttttttggcggttgcggcgagcaaaaagctcgctcctacaggttgtgtgtcctctcctgccggagcgagctggctcgccatcaatggatcactttaacgccgatcaggcgtcgcgaaacaaccacggctggctggcacgatgcttggcctcgaaggcggcaatcgcgtcaccgtcctgcaaggtcaggccgatatcgtccagaccgttgagcaggcaatgcttgcggaacgcatcgatctcgaatttcaacaccttgccatcgggacgggtcacggtctgggcctgcagatcgatctgcaactggtagcccggattggcctcgacctgctggaacaattcatcgacttcagcatcgctgaggatgatcggcagcaagccgttcttgaagctgttgttgaagaagatgtcagcgtagctcggcgcaatgatgctgcgaaaaccatattcttccaacgcccaaggcgcgtgctcgcggctggagccgcagccgaagttttcccgggccagcaatacactggcgccctggtagcgctcggcgttgagcacgaaatccttgttcaacggacgcttggagttgtcctggtacggctggccgacatccaggtagcgccactcgtcgaacaggttcgggccaaagccggtgcgcttgatcgacttgaggaactgcttgggaatgatctgatcggtgtcgacgttggcacgatccaaaggcgcgacaagaccggtgtgctgggtgaaagctttcatgctgcgctccttagatcaattcacggacgtcgacgaaacgaccgttgacggcggcggccgcggccatggccgggctgaccaggtgagtacggccaccggcgccctggcgaccttcgaagttgcggttcgaggtcgaagcgcaatgctcgccggactccaagcggtccgggttcatcgccaggcacatcgagcaacctggctcgcgccattcgaagcccgcttcgaggaagatcttgtccaggccttccgactccgcctgggccttcaccaggcccgaacccgggaccacgatcgcctgcttgatggtcgaggccaccttgcggcccttggcgatgaccgccgcggcgcgcaggtcttcgatccgcgagttggtgcaggaaccgatgaatacccggtccagctggatgtcggtgatcgcctggttggcggtcaaacccatgtatttcaaggcacggacgatggaatcgcgcttgaccaggtccatttccttggccgggtccggcacgttctgatcgacggccaacaccatctcgggcgaagtgccccagctgacttgcggcttgatctgcgcggcatccagctcgaccacggtgtcgaacttggcgtcggcgtcggacaccaggtccttccaggcttcgacggcgaggtcccattgcgcgcccttgggggcgaatggacggcccttgacgtattccacggtcttttcgtccgcggccaccaggcccacgcgggcgccggcttcgatggacatgttgcagatggtcatgcggccttcgacggacaggtcgcgaatcgcgctgccggcgaactcgatggcatggccgttaccgccagcggtgccgatcttgccgatcacggccaggacgatgtccttggcggtcacgccaaatggcaacttgccctcgacccgcaccagcatgtttttcattttcttggcgaccaggcactgggtggcgagcacgtgctcgacctcggaggtgccgataccgtgcgccagggcgccaaaggcaccgtgggtcgaggtgtgggagtcgccgcagaccacggtcataccgggcaaggtggcgccctgctccgggccgatgacgtgaacgatgccctgacgcacgtcgttcatcttgaattcgacgatgccgtattcgtcacagttgtcgtcgagggtctgtacctgcaaacgcgagacctggtcggcgatggcgctgatgccgcccttgcgctccggcgtggtcggtacgttgtggtccggggtcgcgatgttggcatcgatgcgccaaggcttgcgcccggccagacgcaggccttcgaaggcttgcggcgaggtcacttcgtggatgatgtgacgatcgatatagatcagcgccgagccatcgtcgcgctgcttgaccaaatgcgaatcccagagcttgtcgtagagcgttttgccggccatcagacggttcctcatcattttctatgccgcgggtctctgacaccggtcaataaccccttggcttgtgaggctgatgctatggcgttacattaaataactcaaattcatattttttatactttggataaccgactggaatacgaccatggacctggccaacctcaatgcctttatcgcgattgccgaaaccggcagcttctccggagccggcgagcgcctgcacctgacccagccggccatcagcaagcgcatcgccggccttgagcaacagctcaatgtccggctgttcgatcgcctgggccgcgaagtgggcctgaccgaggccggacgcgccttgctgccgcgggcttatcagatcctcaacgtgctggacgacacccgccgggcgctgaccaacctgaccggcgaagtcagcggccgcctgaccctggcgaccagccaccatatcggcctgcaccgcctgccgcccctgctgcgcgcctttacccgccgatacccggaagtggccctggacatccagtttctcgactcggaagtggcctatgaagagattctccatggtcgcgccgagctggcggtgatcaccctggcccccgagccccatacactggtcaaggccacgccggtgtggaacgacccactggacttcgtcgccgcccccgagcacccgctggtgagcaacggcacggtcagcctggccgatatcgccctgcatccggcggtatttcccggcggcaacaccttcactcaccatattgtccagcgcctgttcgaggcccagggcctgaccccgaacatcgccatgagcactaactacctggaaaccatcaagatgatggtgtccatcggcctggcctggagcgtcttgccccgtaccatgctcgacgaacaggtggcgcgcattcctttaccgggcatacagctcactcgccagctaggctatatcctgcataccgaacggacgttgtcgaatgctgcgcgggctttcatggccttactggatgcacaagtcgacctgccagggacccaggcgtaagcgtcccggcatgacttatgccacctctttgcttgcctgaacctgcgcctaacgctcttttcagcccaaggcccgctgctcatgccaaaacccgctgaccgtctaccgcccatgccgcgcattcacgcgctcgacccgaaacagtcggagcaaagctgggagagcgccccgcagttgcttgccgcactcaacggcgcacggctgggcgcctggtactgggacatcgaaagcgggcaaatcagctggtcgcggggcacccaggcgctgtttggcttcgatccgcgccagccgctgcccaaagacctggaatacctcgacctgctgcccgaggaagaccgcgccaaaaccattcgcgccttccattcggtgctggccggcgcgccgctggaacaggcgatgcatcaccgcatccgctggcccgacggcagcctgcactggctggaaatcaatggcagcgtgctgccggacaaacatggcaagccccgaatgatcggggtgattcgcgaaatcacccaccaacgccagcgggaacaggctctcagcagctcggaaaaacgctttgccacgctgtttcacctgtgcccgaacatggtgctgctgacccgcctggaagatggcctgatcagcgaagccaaccagtacttcgaaagcctcttcggctggccggtgcagcacgtcatcggccgcaccaccctcgaactgggcctgtgggtcgacccggaacaacgcgcgcagatggtcaaggcggtacaaaagcgcggccaggcggccaccctcgaggtgcaactgcgcgccagcaacgggcagattcacgacggcattctcagcgcccagaaagtcgagctggaaggccaggcctacctgctcagcacctttctcgacaccagcgaacgcaagctcgccgaacaggccctcaaggacagccaggagcgcctcgacctggcgctggactcggcccagctcggcacctgggactggcacattcccagcggcatgctctacggctcggcccgcgccgcgcagttgcacggcctggagccgatgccgttccatgagtccttcgatgcgtttttcgagggcgtgcccgacgaagagcgcgacagcatgcgcgatgcctaccgcagcctgcgcgaaggcccggccggcaattatcaactgacctaccgcgtacaactggccgatggctcgtcacgctttctggaaagccgcgctcgcctctaccgcgatgagcagggccgtccgctgcgcatggccgggaccttgctggacattaccgaacaggtcgagcgcgagcagcgcctggtgacgtccgaggagaagttcgccagcctgttccaggtcagcccggacccgatctgcgtcacgctccaggaaaccgggcagctcatcgagatcaactccagcttcacccagaccttcggctggaccgccgacgaagtgctcaatcgcagcgccgacgaaatcggcctgtgggacgactccgcccagcgcctgcaacgggtcgaacaggtaatccgcgaacaggcgctgaacaacgtcgcggtggtggtccggcacaaggacgggcaacccctgacctgcatcatttccagccggcagatcaccgtcgacaaacagccgtgcattgtcaccacgctgcgcgacatcacccagcaacaacgctccgaagccgcgctcaaggccagcgaagagaagttcgccaaggcgttccactccagccccgacgccatcaccatcaccgaacgcgacaccgggcgttacctggaggtcaacgacggcttctgccggctgaccggctaccgcgccgaagaagtgatcggccgcaccgtgtatcaggtcggcatctgggccgaggaaaaacagcgctcgatcctgctcgccgagctgcagctcaaaggtcgggtcaatcacctggaaatgctcggccgcaacaagcgtggcgatatcctgacagtcgaggtctcgatcgaacccattaccctcaatgaaaccccctgcctgctgctcaccgcgcgggacgtcagcctgctgaaaaacgcccaggcgcagattcgccacctggcctaccacgacccgctgaccaacctgcccaaccgcgcgctgttgatggaccgcctgagccagcagatcgccctgctcaagcgccacaacctgcgcggcgccctgctgtttctcgacctggaccatttcaagcacatcaacgattccctcggccatccggtgggcgacaccgtgctgaagatcgtcaccgcgcggctcgaagccagcgtgcgcatggaagacaccgtggcacgcctgggcggcgacgagttcgtggtcctgctcagcggcctggaaggcagccgcagcgaagtcagcgagcaggtgcgtgaactggccgataccctgcgcgagctgctgtccgaaccgatgttcctcgacggccagcgcctgcaggtgaccccgagcatcggcgtggcgctgattcccgatcacggctcgacccccaccgacctgctcaagcgcgccgacatcgcgctgtaccgggccaaggactccgggcgcaacaccacccagatgttccacaacaccatgcagaaagccgccagcgagcgcatgcgcatggagaccgacctgcgcctggccctgtcccggggcgagttcagcctgcacttccagccccaggtcgatgcccgcgacaaccgcatcgtcggcgccgaggccctggtgcgctggcaccaccccgaactgggggcgcaatcgcccaccgagttcatcaaggtcctggaagacagcggcctgatcctcgaggtcggcacctggattctcgacgaagcctgccaggccttcagccaactgatcaccgaaggcctggtggacccgctcgacttcagcctgtgcgtgaacatcagcccgcgacagttccgccagaacgacttcgtcgagcgtatagagaacagcctgagccattaccagctgccgccttcgctgctgaagctggagatcaccgaaggcatcgtgatccagaacctggaagacaccatcggcaagatgcgtcgcctgaaaaaactcggcgtgagtttcgccatggacgacttcggcaccggttattcgtcgctgacctacctcaagcgcttgccggtggatgcgctgaagatcgatcagtccttcgtccgcgatgcgacccacgaccccaacgacgcggagatcgtgcgcgccatcgtcgccatggcccgcagcctggacctgaaggtgatcgccgaaggcgtggaaaccgcggagcagctcgagttcctgcaaggcctgggctgccatttgtatcagggttacctgcacagccgaccgctgccgctggagggtttgaaagccctgctggtctgagcgggcgacatgcaatcgccggcctgacagatcaacggggcagcaattgccagtgtttggcacaacctgtagggtcgcgttttttgtgacgcccacgagatcgatcatgcaggatgcaaccctcccccgcccggccctgctgggcattgaccttggcaccaccaacagcctgatcgccgtctggcaggacggccgcgcccagttgatccccaacgccctcggcgatgtcctgaccccgtcggtggtcagcctcgatgaagacgacagcatcctggtgggcaaggccgcgcgggcccgcctgacaacccacccggaacgcacggtcgcggccttcaagcgcttcatgggtagcgacaagcgcctcgaactgggcggccggccgttcagcccggaagaactctcggcactggtgatcggctcgctcaaacaggatgccgaagcctttctcggccatccggtgcaggaagcagtgatttcggtgcccgcctacttcagcgacgaacaacgcaagcgcacgctgttcgccgccgaactggcgggcctgacggtgtcgcggctgatcaacgagccaactgcggccgccatggcctacgggctgcatgaacagaagttcgaacgcacgctgatcttcgacctgggcggcggcaccttcgacgtcacggtgctggaatacgcactgccgctgattgaggtgcatgcctccaccggcgacaacttcctgggcggcgaggactttaccgaggccttgttgcaggcctgcctcaaggactggcaactcaccccggcgcagatcgacgcccagggcatggccagcctgggcgacgccctggagcagctcaagtgcacactcgccgaaggcactcagtcactgaactggcgccatggggacacctcgtatgaatggacgctggacgaagcgctggcactgaaaatctgggaaccgctgctggcccgcttgcgcgcgcccatcgaacaggccctgcgcgatgcccgcctcaagcctcgcgacctcgacagcctggtgctggtgggcggcgccacccggatgccggcggtgcagcagatggtcgccactctgttcggccgcctgccttaccgccatctcgacccggatacgatcgtcgcgctgggtgccgccacccaggccgcctgcaaggcccgggacggggccatcgaagaactgatcctgactgacgtctgcccctacaccctggggatttccacccgtcgcggcgaacaggtcagcggggccttttcgccgatcatcgaacgcaacacggtaatcccgacctcacgggtgcagcagttctacaccacacatccgcatcaggcgtttatccgcatcgaggtgtaccagggcgagcggccctgggtacgggacaatattttcatcgacgccttcgacgtgcccctgacgcccagcgaacagatccagtccctggacgtgcgcttcagctatgacatcaatggcctgctcgaagtcgacgtcaccctgctggccagcggcgaacgccatagccacagcatcgaccgcagccccaccgggctcgatgcgcaatcccggcaggccagccatgagcggctgaccgcgctgaaaatccatcctcgcgacgccctgcccaaccgcaccctgctggcacgcctggaacgggcgtgggcgcaaagcctgggcgacgagcgcgaacagatcgccgactggctgggcaccttcaccgccgtgctcggcggccagcaaccagcgcaaatcgccagccatcgaacccagctgaacaaggcgcttgaccaactgcgtctctagccgttgagccgccgtaaacaggcctgcaaaccaccgggcagcgcgtcttcacccgcgctgtccggcggtacgccatagcggttgggcagcttgtcgccgggaaaggcgaacaggatcagcgacagaaatggaaagaacaccgacagaccgcccagcaccagcaaggtcgggataccacgccccatgtcatgcaggcggcgcagaatcaccccgagcaaaaacaggctgcccagcaatgacacaacgatcgcggacagcgacgtgccgctgaacaacgcggccagcggggtaaccagcacagcgcccagcacctgccagaagaacgccccacgccccagccgcgtgcccagacgccagaacgccgtggcgggcgtcggacggctgtcgcccttggccagcagcagacgctcgctccaggacagcagcgcactgaaggcaaagcgcaggccgagtccgtgctccggattgtccttggcccgctgcatgcgcagcagcactttctgccgaggcaccccggcactgccgtaacgcaccagccccttgagcacatcgagggccaggtaaaaagcctcgctgtcgatcccttcgtcttcgaccagcgtctgctgcggcggccgtggcggctcgcccttgatcaagccgtggcggaagccgtcgaaccagtcctggggattggtgacttcggtaatccgatcgagcaggtatcgacgctgctgcgcatcgatcaccgggtcgtgatacagcacaccgctcaagagcatgcgcccgagcaaatcgtccgcgaaggcgtgcaggtcgctgcgcaggcatgcgaacaagcgctcattgctcaacaaccgcgcactgtcgagcgcttcctggacgccaagcaattgccggtcgagcaaggcatgcagcggatccgccaattgcagccagccgagcaaagcgctcaggtcgccctgttcgcgctgtaattgggcaagctgcggctgcagccggctgagcggatgggacggattgagcgccagacgctccagacaccgcgagtcgatcaattgccaccagcgttccggctgctgcagcaaggccatcaggaacagcgtatgggtaccagtgccagaccgcctctcccgcccctggcggcggcaacactacgccatgctggctcagttgcagcagcaggtgcagttccgacaaatcgctagcggcatccgtatcgttcaattcgaaagactcggcgatacgctccagggcagcgtgaccgtaagggcgcaatcggcgcagccacacacggcagatcttatgcggctcaccggttgtcagcgcaccggccagttctaccgaagccgcgccctcatcaatgaaggcattcatcgccaacggaatcggcgcctggctcaaccagcgcaagtgctgcccggcctggtccttgaacccgctcagcaccaggccttcgagggcatccagtggctgcggttcgtccagcacctgttgcaacagatctgctgcgccacggtgcaaggcccaggcatgccggtacaggcgcaacaaccgggtgtcggtgttctggcccagcaactgcgccagcaagggcaactcgtcgccggtcattcgccagtcgataaaggcctgcgccaatccctgcagctcgagccggccaacgccgagccagcggatcagcgtctcgggacgttgtgaagggctgccgtattcctgagtgacatgggcgagatcggtggaccagccgctgaagttctccagacgatcaaacgcctggatcagcagcggcaaaaagtccggctgacgtttggcgcacaacgccagtaattggctctcggccttgggatgacgatgctcctgccaaagccggacccagcaaggcaacgcctgatcgtccagccccagcaggctgttctggcacgccagcaagtacagccagtccatatcatccggcgcttcgcgctgctgctcgatgcacagctgcaacagcccctggccaccgatgccggcctgggtgaattgcaccagcaagcgcttgatgaagagcgcatcgttcggcaacggcaggcaggtgtgttggctggcgaagccttcgtactcgtggagcggtcgccggtcataaatgaagtcgagactgcgcgcgtaccacaggctttcggtctgtgccggttccgaccagttccccatcagcgccgtatcgaatgggtccggggtcttgatccggttcagatagtcctcgacatgccgggcctgatcgaaccccagctccagcacctgatgctcccagcccatgcgctgggccagcaggcccgcgcaacgatgggacagcggtccggcattggccgtccgcccgaacaactcccagcgcaggtcatcgagcatgccgagcggcagttgatcgagtgtcttgataaaggcctgccaggcctcaggattgaagcgtcgcgccggatcactcagcagcgcatcaaaatcgaggatggcttgcgcaggctcaggctcgctctcctgcgccgcttcaagttcctgctccttgtcacgcaccagccgcagggcactctcgtaggcctggcgcagtgcctggaacccttcgggatcggtctccgggtgatgctccggcagacgggcacgataggcattgcgaatcagcgtttcatcggtggtagggtcgatacccagctttatccagcaactcatgaccagtcgaactcctcaagcgacgccggacattgcggcaaatcgagatccaggtgccagggcaagtccgccaggcagtccgccatgttttgcgcaagcccctgggcgatcatcaggctgttggggttctccccctgtcgatccagctcgtaagccagttcgtcgtcgctattgcccaggcaaccccagaacgcgcggccaaccaggaaaccattgaaataggcgaaccagctgccgtagtggtattgcgccctgaccgccagccggccgtgcagccataggctctcggccagatcgatccactggttgcgcacgccgcaacgcaacagaaaccccatgcgcccgtaatcccaggccaggatcccgcccgggccacaagcgccaaaggtacggctggcgaactggtgcaggatgcgttcacggggttcgagcgtctcgagcagggcctgccattcgctcggcagacaacgctgccaggcgcgatacgcgtcgtcgaggtgggtggcatgaccgttgtcagtcatcctttccagcatgcccagcaactgccgccggtcactgatgccccaactgccttgcaggtcgatggattccgggccggggtagaacgcggggttgtcgtatccggcgcgagggttgagcgcaaccatcggcgcagagaggctccacagccagcgctggtgtatctcgtccatgaaaaaggctccaggccgaccggtgaggaatgggggggtcggcaaaactgcggcggattgtagagaaaccatcgcaggcagcaaaggtgaacgatgattctgccgggcataaaaaaggccccgacaagtcggggccttcatttggcgactcagcgctcgatcaagcgcctgcattgctgcgcatggatcaatgctgcagagccgcttgctgcgtcccgttgattgggatgcgcttggctttcgcctcttccgggatcactcgcagcaggtcgatgctcaacagaccgttgctcaggccggcggccttgatctcgatatgatcggccaggcggaaggacagcttgaacgcacgctgggcgatgccctggtgcaggaaggtgacgccttcgttcgcgtcacgcttgccgccactgatggtcagcacacccttctcgacttgcagctccaggtcttcttcctggaacccggcggcggccacgacgatgcggtattggtcgtcaccgtgcttttcgacgttgtagggcggataggtgctgcctggctcattgcgcagggcggtttcgaacaggtcgttgaaacggtcgaaacccaccgaggaacggaacagtggcgcgagggaaaatgcagtactcatggttcaaatctcctgaaaacaatcagcaagtttttttgtctccgcgacccgaattcggcatcgcgtaacccttagatagggaccgccaattgcatttcaagagacttttcgcagatttttttcaggccgcctcggccaccggcaagcccagcaaacgcgagacttgatccggctcggtttcgcgacgcaagacggtgaacagcgccaccgcctcgggataattgcgggtcagcatcgccaaccactgcttcaggcgacccggcgattggcgagccgtcatctgcgccttggcttgcagccagaagtcctggatcagcggcatcagctcggcccaggtcatctcgaccacttcttccccggcccgcgcggcggcgatttgccgggccaggtccggacgcgacaccaggccacggccgagcatgatgtcttccaccccgctaatttcgcgacagcggcgccagtcttcgacactccagatatcgccgttggcgaacaccggcaccttgaccacgtcctgcacccgcggaatccactcccagtgcgccggcggcttgtagccgtcgaccttggtccgcgcatgcaccacgatatgttccgcgccgccttcggccagcgccgtggcgcacaccagcgagccatccggactgtcgaagccgaggcgcatcttggcggtcaccgggatgtgcgcaggcacggcacgccgcacatgctcgacgatctggttgagcagttccggctccttgagcagcaccgcaccgccacgggatttgttgacggtcttggccggacagccgaagttcaggtcgatgacttcggagccgagctcacaggccagggcggcgttttccgccaggcataccggatcggaacccagcagttgcacccgcagcggcacgccggacgcggtccgggcgccattcaacaactcggggccgaacttgtggaaataggccggtgtgagcaactggtcgttgacccggatgaactcggtcacgcaccagtcgataccaccgacccgggtcagcacatcccgcaggatgtcatcgaccaacccttccatgggcgccaaagcaatttgcatgaatcacactcaacgtaaaacgcggtaaaaaaacgtgcggcagtttactgggtttcgctgggaagcaggtatttcaacgggtggatggtcgcgggccagctcagctcgccccttgcaacgccggcccataaccctcgagaaactccgccggcatgcgcttgggcttgccgctggacagctcgatgcagacaaaggtggtctgggcccgcagcaaggtgctgccatcgctcgggcgcaccagctggaaacgccgcgacatcttcaggcgctggtcccagtcgacgatccaggtcgccagctgcagctcgtcgccttcataggccgccgccaggtagtcgatctcgtggcgtaccaccgccatggcccgatccaggcggcggtattcgctcaggtccaggcccaggcgctgggaatgacgccaggcgcaacgctccagccaagtgacgtacaccgcgttgttggcgtgccccaagccgtcgatgtcttcggcacctacctgcagatcgatgataaacggcgttgccagatcccagcccatgccccactcccggtcagattattcgaccggggcagtgtaacggattgctcaggcggattggcgcgcttgcaggctgcggccggccaacagcgtcagcacaccctcgatcagccgcggatcggccaatacgcgctgatgcccgccctccttcaggcgcagcaagcgactgtcaaaccaggcgtcgtggatcagttcggactccttgaccgggacaaagcaatcgtcttcggcatgcacgatcagcccgggcatatccagctggtagtgcgcgacatccagggctgcggcgcgcatgccgacatcctgctccacctggcggataaaggccgagcgtgccttgggcggcaggcgcacataacgggcgaagccgcgcaacacgccgagtatccgcgccggggcggcgatgctgaccagggtctcggtacgcaagcccagctgcaccgccagcatggcgctggcgccacccatggagtggccgatgaccgcgcgcagcggcggcaactccgcggcggcttcgagcatggcccgggcaaacagcatcacattggcctcgcgaccgggagaacgcccgtgggcgggaccgtccagcgccacgacgctgtagccggcgtccaccagcgcatcgatcaggctggcgaactgcgtggggcggccttcccagccatgcatcagcagcaccgccggcccctggccccagcgcaatgccgagagcccgaagcgcagggtgatacgctccgaacgcgccagcagcggcaactcccagtcacgcggcagccgctcgcgcggcgtcatgaaggccagccgcatcttgctggcgaccagcttcggtgcaacccagcccaaggtgccgttaacgccacgaacccaacttaacgtgctcatcgcctctctcctcaggccagcgcctcaggtcatagcaccgccgacttggcagcgcgcagtaaacggtccgacagctcaccggctcccagcgcccgggccagggacaagccgcccaccatcagggccagatcggccagggccttgtcggtgtcttcgggggtggtcgccaactgagccagcatcagctcgatgtgttcattcaggactttgcggaaatcgtccggcaggcgccccatttcaccgaccgacgcggggatcgggcaggcctgttcggtggaatcgcggtgcttgcgcgacagatagaacgctgccaccagcgctcgccgctcctcgccggtcaacgatgcgtccatatcggcgatcaggccccggcgctgggccagcaattgactgaacgcctccagcatcagggcgtccttgctttcaaaatgcgcgtagaagccaccgaccgtcaggcccgcggcacccatcacttcgcccacgctcggctcggccgggccacgctgcaccagcgcggtgctggcggcctggagaatgcgctcgcgggtttgagcttttttatcgttcatcgttgcctccgaatattacgatcaaaatattattcccataataaattttcgcaagtcgttagtgtgaccgtcggtcaggagaacagtgtggggagaaagggagaattggccaaacgccagacaaacaaaagggccattcaataattgaatgacccttataaatcccgcagagcgggtaaacgtggcgtcccctaggggactcgaacccctgttaccgccgtgaaagggcggtgtcctaggccactagacgaaggggacacaaacccttctatacaactgatcagtgctgagagctgatcgattcaaggccggtgtggccagaccttgagctgtaaaattggtggagctagacgggatcgaaccgtcgacctcttgcatgccatgcaagcgctctcccagctgagctatagccccagatttttcgcctcgcggcggagcgacatcttgcaacatcgcttctgtaaaactggcgtcccctaggggactcgaacccctgttaccgccgtgaaagggcggtgtcctaggccactagacgaaggggacgcaaacccttctaacaactgatcagcgctgagaactgatcgattcaaagccggcgtggccagaccttgaattgtaaattggtggagctagacgggatcgaaccgtcgacctcttgcatgccatgcaagcgctctcccagctgagctatagcccctcgtcggtgaggacggggcgaatcttaagggcgtatcggaaggctgtcaaattttttttcagctttttttaaaaaaatttgccggcataacaatcacttaccaccctcccccgtaaatccggggcttttgccgaccgttgtaccctccaccaacggtcgcgatctcacttcttgcgcaggtccgcgggagccagcatgccggctcccgcgaatcagcaggctgaatcaggcgatcgcgcccagcagcttttcccactctttgttttctttcttcgacacgccacccagcaggtcgatggcctgacgcaggcggaaacgggtcaggtccgggcccagaatttccatagcatcgagcaccgagaccgagctggcctgaccggtgatcgcggcgaacatcagcggcatggcatcacgcagcttcagctccagggattcgaccacggcctggatggtcgcggtgatgctgtccttttcccactggcgcaggctttccagcttccacaggatcagttgcatcaactgccgcacctgatcgcccgaaagcttcttcgattcgaacagcttggcatccggggtcacgccaccggcgaagaagaacccggccaacggtgcgatctggctgaaggtttccacccggccctgcacgtgcggcgcgatcttcatcaggtattcggggttcagcgcccaggtctgcacgcggctggcgaactcctccaccggcaggtcgcgcaaccactggccattgagccacgacaatttctcgatatcgaaaatcggcccacccagggagacccgcgacaggtcgaagttgtcgaccatttcctgcagcgagaacttctcgcgctcgtccggcatcgaccagcccatgcgacccaggtaattgagcatggcttccggcatgaagcccatgcgctcgtagaaggtcacggaggtcgggttcttgcgcttggacagcttgctcttgtccgggttacgcagcagcggcatgtagcacagctgcggctgctcccagccgaaatactcgtagagcagaatcagtttcggcgccgaaggcagccattcttcgccacgcaatacgtgggtgatgcccatcaagtggtcgtcgaccacgttggccagaaagtaggtcggcaggccgtcggtcttcatcagcacttgcatgtccatgcgatcccacgggatctcgacatcgccacgcagcatgtccggcaccacgcagacgccttcgctcggcaccttcatgcggatcacgtgcggctcgccagcggccaggcgccgcgcgacctcttccttggacagcagcagcgcgcgaccgtcgtagcgcggcgtctcgccacgggccatctgctcggcacgcatctggtccagttcttcggcggtgcagaagcacgggaaggcatggcccatgtcgaccaactgctgggtgtacttctggtagatctcgctacgttcgctctgccggtaaggaccgtgcgggccgcccacgtccgggccttcgctccagttgatgcccaaccagcgcaaggcggcgaaaatctgctgctcggactcgcgggtcgaacgcagttgatcggtgtcttcgatgcgcaggatgaactcaccgccatgctgcttggcgaagcagtagttgaacaaggcgatgtaagcggtacctacgtggggatccccggtaggcgatggcgcgatgcgcgtgcggacggtggtcatggcatgtctcggaaagaatatgaaaagcgaagatcaaacaagaggcgaatggtaacaggcgatgccggccccgctccagtgagcagggcatttaagccaaggttgaggctactcgagtcgcccgggccgccgaaccgccgattatccgcccgtggcatttaccactggtcggccgtatgccagattcgccctctgacaaatttccttacatttacctgagcgcagcctgccgccccatgccagttcaactcaagcgtcgcctgtttattttcctgttcctggtcctgctgattgccctgggctttctggcgcagtggtttttccatggacgcttttatgaaagcaccgataacgcctatgtccagggtgaaatcacccgcgtctccagccagcttggcgcgcgcatcgacgaagtgctggtgcaggacaaccagcacgtcgaaaaaggccagctgctgatcaggctcgaaggcgatgatttccacctcgccgtggatcgcgccaacgccaccctggccacccgcgaggccgaacgcctgcaagcccagagcagactcacgcaacaggccagtctgatcgccgctggcgaggcccaggtggcttccagccaggccagcctcgggcgttcgcagatcgacctgtcccgcgcgcaaaccctgcgcaagccgggttatgtctcggaagagcgggtcaccaccctgtccgccgacaaccatatcgcccgctcgcaagtggccaaggcccaggccgacctgcaaggccagcgccagcaggtcaatgccctgagcgccgagatcaagcgcctcgacgcgcagatcgccaatgcccgcaccgacctggcccaggccgagctgaacctgacccgcagcgaaatccacgcccccatcagcggcctgatcggccagcgcgcggcgcgtaacggccagtacgtgcaggctggggcctatctgctgtcgatcgtgccggaccaggacatctgggttcaggccaacttcaaggaaacccagatcggccatatgcaaccgggacaaaaggccgaactgctgttcgacgcctacggcgacacgccgatcgaagcccgcgtcgacagcctgttcgccgcctcgggcgcgcagttcagcctgctgccgccggacaacgccaccggcaacttcaccaaggtggtgcagcgcattccggtgaaactgacctttgccgccgacaacccgctgcacggcaagatccgcccgggcatgtcagtcactgtcaaagtgaatatccagcccctgaacccagaaccctcgaacgatggccggtgaccaactgttgcgcccggtcggcgaaccgacccggcgcgactggatcgcagtgatgagcgtgatgctcggcgccttcatggcggtgctggacatccagatcaccaacgcctcgctcaaggacatccagggcgcgctgtcggcgaccctcgaagaaggctcgtggatctccacctcctacctggtggcggagatcatcatgatccccctcaccgcctggctggtgcagctgctgtcggcgcggcgcctggcggtctgggtctcggcgggtttcctgatcgcctccctgctctgctccatggcctggagcctggaaagcatgatcgtgttccgcgccctgcagggctttaccggcggcgcgctgatcccgctggcgttcaccctgaccctgatcaaactccccgagcaccatcgcgccaagggcatggccatgttcgccatgaccgccaccttcgccccgtccatcggcccgaccctgggtggctggctcacggagcactggggctgggaatacatcttctatatcaatatcccgcccggcctgatcatgatcgccggcctgctctatggcctggagaagaaggaagcccattgggagctgctgaaaagcaccgactacgccggcattctcaccctgggtgtcggcctcggttgcctgcaggtgtttctcgaggaaggtcaccgcaaggactggctggaatcgaacctgatcgtcagcctgggcagcatcgccctgctgagcctgatcacctttgtcatcgtccaggtgtccaagcccaacccgctgatcaacctgggcatcctgcgcaaccgcaacttcggcctgtcgagcatttccagcctgggcatgggcgtcgggctgtacggttccatctatctgctgccgctgtacctggcacagatccagaactacaacgccttgcagatcggcgaagtgatcatgtggatgggggtgccgcagctgttccttattccgctggtgccgaagctgatgcagttcatctcgcccaaatggctgtgcaccctgggctttggcctgttcggcctggcgagtttttcttcgggggtgctcaacccggacttcgccgggccgcagttcaaccagatccagatcatccgcgccctggggcagccgctgatcatggtcaccatttctttgatcgccaccgcctacatcctgccgcaggacgccggctcggcctccagcctgttcaacatcctgcgcaacctcggcggcgccatcggcatcgccctgctcgcgaccctgctcgatgcgcggaccaagacttacttcgactacctgcgcgaatccatagtgccgagcaacccgcaagtggccgaacgcctggcgaccctggccgagaagttcggcagcgataccgccgccctcggcaagctcagcgaaatcacccaccagcaggcgctgatcatggcctacaacgacgccttccattttgtcgggatcgccctgggtgtcagcatgctggcgattctgctgaccaaggcgctgccggccgggatcaaggccggggaagcgcactgacttgccagggtaaccgctgtagtcgctgccgcaggctgcgataggcccgaaggaccttcagcggtagtgataccgccacggccgtaccggccgatcgcagcctgcggcagcggctacaggtgaggctcaaaccgtcagcaagcgctcgcgcagcttgccgatttcgtcgcgcatctgcgccgcggcttcgaactccaggtcgcgggccaactggtacatcttctcttcgagctggcgaatgcgcttggtgatctcgctgggcgagcgcagttcgttttcgtagcgggcgttttcctcggcggccttggccatgcctttgcgcttcttgctgcgcgaaccgggcacggtggcgccttccatgatgtcggcgacgtccttgaacacgcctttgggggtgatgccattggccaggttgaaggcgatctgcttgtcgcgacggcgctcggtctcgccgatcgcccgctccatggaaccggtgatgcggtcggcgtagagaatcgcccggccgttgaggttacgcgcggcacggccaatggtctgaatcagcgagcgctcggagcgcaggaaaccttccttgtccgcatcgagaatcgccaccagcgacacctccggcatgtccaggccttcgcgcagcaggttgatccccaccagcacatcgaaggtgcccaggcgcaggtcgcggatgatctcgacccgctccacggtgtcgatgtccgagtgcagataacgcacgcgcacaccgtgatcggcgaggtaatcggtcaggtcctcggccatgcgcttggtcagggtggtcaccaggacccgctcttccacggccacgcgcttggtgatttccgacagcaggtcatcgacctgggtcagcgccgggcgcacttccacctgcgggtcgaccagcccggtcgggcgcaccacctgctcgaccacgcggccggcatgctcggcttcatagttgcccggcgtggccgagacgaagatggtctgcgggctgaccccttcccattcgtcgaagcgcatcggccggttgtccagcgccgagggcaggcggaaaccgtattccaccagggtttccttgcgcgaacggtcgcctttgtacatggcgccgacctgcggcacgctgacgtgggactcgtcgatcaccagcaaggcgtccgccggcaaatagtcatacagggttggcggcgccgccccggcaggccgcccggacaggtagcgcgagtagttttcgatgccgttgcagtaaccgagctcaaggatcatctccaggtcgaaacgggtgcgctgctccaggcgctgggcttccaccagcttgttgttgctgcgcaggtattccaggcgttcctgcaactcgaccttgatcccctcaatggcatccagcagggtttcccgcggcgtcacgtagtggctcttgggatagaaggtgaaacgcggcagcttgcggatgacttcgccggtcagcgggtcgaaggcggagatgctttccacctcgtcatcgaacagctcgatgcggatcgcttccaggtcggattccgccgggtagatatcgatcacgtcgccgcgcacgcgaaaggtggcgcgggcaaaatccatgtcgttgcgggtgtactgcaggtcggccaggcggcgcagcaaggcgcgctggtcgagcttgtcgccgcgatcgacgtgcaacaccatcttcagataggtttccgggctgcccaggccatagatgcacgacaccgtggtgacgatgatcgcgtccttgcgctccagcagcgccttggtcgccgataggcgcatctgttcgatatggtcgttgatcgaggcatctttctcgataaaggtgtcggacgaaggtacataggcttccggctggtagtagtcgtagtaggaaacgaagtactccaccgcgttgttcgggaagaacgccttgaactcgccgtacaactgcgcggccagggtcttgttcggcgccagcaccagggtcggacgctgtacctgggcgatcacgttggcgatgctgaaggtcttgcccgagccggtcacaccgagcagcgtctggtgcgccagcccggcctcgatgccctcgaccatcaggcggatggcctccggctggtcgccggcgggctggaagcgggtgactagctggaattcagacataacgtacctctgggttcactccagcacgacgccgccgcacaggaacgagaaagaccacaaacgacgagcgtcgccgggaaaatactggattgtgctggatgtggaggcaaattccacagctttcaaggcaaaggtcccagggccctgtacgattttgacgttgcaataagactaacggtcgaaaaataaaccgaaaaacttgccggaaaagccctttcagctgtcgccgcgcacagtgatggcctctatactagctccccgtttgtgcaccgctctagtgcattcggctggagcgcgacacgtccctccacactccattcagagccgccgtaataatgagcctgttctccgctgtcgaaatggcaccacgcgatcctatcctgggcctcaacgaagcattcaacgccgatacccgtaccaacaaggtcaacctgggggtcggtgtttattgcaacgaggaggggcgaattccactcctgcgcgccgttgtcgaagccgagacgatccgcgccgctcaacatgcctcccgtggctacctgccgatcgacggtatcgccgcctacgaccaggccgtgcagaagctgctgttcggcaacgactcgccgctgctggccgccggtcgcgtggtcaccacccaggccgtcggcggtaccggcgcgctgaagatcggcgccgacttcctcaagcagttgctgcctgacgcggtcgtggccatcagcgacccaagctgggagaaccaccgcgcgctgttcgaaaccgccggtttcccggtgcagaactaccgctactacgacgccgccacccacgatgtgaaccgcgtcggcctgctggaagacctgaatgccctgccagcccagtcgatcgtggtcctgcacgcctgctgccacaacccgaccggcgtcgacctgagcccggaagactggaaaaacgtgctgcaggtgatcaaggcgaaaaacctggtgccgttcctcgacatggcctaccagggcttcggtgacggcatcgccgaagacgccgccgccgtgcgcctgttcgccgaatcgggcctgaccttcttcgtctccagctcgttctccaagtcgttctcgctgtacggcgagcgcgttggcgccctgtcgatcgtcagcgaatcgaaagaagaaagcgcgcgcgtgctgtcgcaggtcaagcgcgtgatccgcaccaactactccaacccgccgacccacggtgcaagcatcgtcgctgccgtgctcaacagcccggaactgcgcgcccagtgggaagccgaactggccgaaatgcgcctgcggatccgcggcatgcgcctgcagatggtcgacctgctggccaagggcgcgccacagcgcgacttcagcttcgtcgcccgccagcgtggcatgttctcctactccggcctgaccgtcgaacaagtgacgcgcctgcgcaacgagttcggcatctacgccctggacaccggccgcatctgcgtggccgcgctgaaccagaacaacatcgacgttgtgaccaaggccatcatccaggtgatctgagccacgtgcggtgaatgaaaagggggaagcctttgggcttcccccttttttgtgggtcgccctcgccagcccgatgcccactagactgaatccagcttgccttcttccctatcgcttccctatcgagaattcccatgagacacgacgacctgcgagccgaccgcgacgaactggaccacttcccccgcccgcagaaacgtgaaaggaacctggtcctgcaaattgccctgggggtatttctcggcggcctggcgctgtggctggtgcaactggccgccacctcgctggccgcgaagctcatgctgggcaccttcactttcggcggctgagaacgctcaaccggccagttcagcgctgcgctggctggcggcatcatcgaaggccacgtacagcgactcggcgacctggctcttgatggccttggcgctttccagcccgaggacaaaaccttcggccttgccacccgcgcggttcagttcagcggccgatccggcctgggtaatggcatcccacagtttcatggcctggggaccgacacctttgggcaggctgatctgctcgatgctcataaaacctcctcaggccgaggcgacagggcaagcagtgtggcgggtaaaaacttgaacagggtcatgagcgttaccttttcggctggaagccgggagcgcgtgaaaccactgccggggcgccatggtagacctgtgccgcgattccggtaaccgccaacgggcaaatagccgcggattggcataatggccagggtcgaccaggctcactcaagcgaaaaattatttggagaggcttgacttctccttcttaatcagtaagatacgccgcattccgcgatagctcagttggtagagcaagtgactgttaatcactgggtccctggttcgagtccaggtcgtggagccatcttcctacactgattggccagcaacatttcaaggagcgccctgctcctgcggcgaatcagttcagcgttaccctccccaagatcgattcagcgcatgccagaccggcatgcggatacgcgtttgcgctgcgcccgattccagcctgtctccgattgcctggcgccagcgcctgaagtaggctgtgccccttctcacgccagccgtcacgactcatgtttttccccgcacagctccatcacagctttctctcgatgagcccatcgcagaccttcgcggtgtcgcaatccgactgcgcgatcaatcgacgccgccgcagcgtgctgttcgccttcaccttctcccctcacgcctgaaccccaccgttgcgcctgaagccggcgcggacctgatacagctgccgcgcttgttcaccgcgcactgacccatccgccgctttgcaccgcagaaccccggcccgacctacgcccgcgtatgccgaaccgcacccctgcccgagcaaaagcaccgcgccacaacaaaccgtttttgagcgcccgccccgtcgggcgcagctgtattccatgaataaaaccctgttggccgcgctgatcctcggcatctcgattgtcggcctgagcatcggttccaccgtgccggtcattgccttgcgcctgtaccaggccggtgcctcgaacacccagatcgctatcatgtcggcccttcccgccgccggcatgatgctgtcggctttcctggtgaacggcctgtgccggaaactcagccgccggcagatctacctgctgtgtttcagcctgtgcgccctcagcatcggcgccctggaactccccgggatcagcctgaccggcctggggctggcgcggatcgtcatgggcttcggcgccgggctgatcatcatcctgggagaaacctgggtcaacgagatggccgcggacgccgtgcgcggccgagtgatcgcggtctacaccacctgtttcaccgtgttccagatgatcggccccggcctggtggccctgctcggcaccgaggggccggcggtgatcgccacggtcagtaccggttacctgctggccattgcagtgatctggctgaccctgccacgtcagcgccccgtttctggacacgccgcaaacaaaagcttctcggtgctgggctttatccgggtggcgccggcgctgtgcgtgggcatcctgttcttcgccttcttcgatacggtgattctctcgctgtttccggtctacgccgcgactcacggctacgccatcaagctcgcggcgctgatggtcagcatcattctgctgggggatgcggcgttccagtttcctctgggctggctgtcggacaaggctggacgcgccgtcatctacctgggctgcggcgtggtgtcgttgctgatcggcctggggctgccactgctgatgaactacccggcgctgctctggccgagcctggtgatactcggcgcggcggccggcggggtgtacaccctggcgatcatcctgatcggccaggagttcagcggccctgatctggtcacggccaacgccagcgcgggcttgttgtgggggatcggcagcctgctgggccccttgctcagcggcgcagccatgagcggtggcgcccacggcctgcccttgacgctgtcggcggcagccgccgtggtggtgctgttcgccttgacgctggtccgccaagggctgccagaccgagtcgcagagtagctagccggccaggccggattgattgcgtccagcctggcgactcggccggccctagaccttgctggtttcgaccgcgcccgaggcatgggacgacgcctgatgagcagccggagcatgctcgccatgggacgtatccaccaccgggatctcgttgccctcggcatcgtgcagcttgccgccgctgaaataatcgccctcacgcaacgctgccaggtcctggtagcgcagggtgcgctcggacgccacggcgaacaccgattgctggtccgagttgcccagggtgaagtggttgaaggtgaggttcagcacaatggccatgatcgccgaggagctgatgccggaatggaagatggtggcgaaccagctcgggaaatggtcgtagaagttcggcgcggcgatgggaatcatgccgaagccgatcgaggtggcaacgatgatcaggttgacgttgttgcggtagtcgaccttggacagggtccggataccgctggccgccacggtgccgaacagcacgataccggccccgccgagcaccgaggtcggcacggcggcgatcacccgccccatgaacggcagcaggccgaggatcaccaggaacaccccgccggtggccaccacataacggctcttgatccccgtcaccgccaccagcccgacgttctgggcaaaggcgctctgggtgaaggaaccgaagatcggcgcgatcatgctcgacagcatgtcggcgcgcaggccgttgcccaggcgcttggagtcgaccttggtgtcaatgatctcacccaccgcgaggatgtcggccgaggtttccaccagggtcaccatgaccacgatgcacatcgacaggatggcggcgaaatggaaaatcggcatgccgaaatgaaagggcgtcgggaagccgaacatcggcccctgggcgaccatggagaaatcggccatgcccaggaacaccgcgatgatcgtgcccaccaccatggccagcaggatcgacagccgcgagatggtcgcgctaccgatcttgctcagcagcaacaccaagaccagggtgatcgccgccaggccgatattggccatgctgccgaagttttccgcatggctgttgccacccatggcccagcgcgccgccactggcatcagggtcaggccgatggtggtgatcacgatgcccgtgaccagcggtggaaagaacttggtgatgcgtgaaaacaccggagtgatcagcagaccgatcaacgaggcggcgatcaccgccccgagaatcgactggaagcccccttcgccaccgctgctgacaatcgccaccatggtcgccacgcccgagaaggacacgccctggaccagcggcagctgacagccgaaaaacggcaggccgagggtttgcaggagagtcgccagaccgccggcgaacaacgacgccgcgatcagcagaccgatgtccgccggcgccaggccggcggcctggccaacgatcaaaggcaccgcaacgataccgccatacatggtcaggacatgttgcaggccgtaagccatattcgcgccaagacccaggttttcatcttcaggccgttgcggtgaaacagagggcgttttcatggttggggagttccctggtttttgttatggggcacactgtattcaacagtcgggacaaatgtctatagagttgtatacactttattcgacactgcccaacctcaaaaaccagcgaaacctgatagccagcctccgcctttttcccgccgaaccccgccccagaccagccaccctgatagaatcccagcccccgcggcgcccacacaggtgacaccctccgtccgcgcatggaagcgatcgaatgaatcatctctggcataccttccgcctcgcctatagcagcttccgcacggtcgtggccttgcagggttttgtcctggccatgtatagcgccagcttcaccgacagcctgtggcaagggttctgggctggcctggggacctttgccctgttcgtcgccggcggcgcgatattcggctttctgcccatggcgctggtgtttaccccgttgtacgccctgctctgcgccaaaggcctcgccaattggctcagcagcctgctgctggggctgtcgatcgccggtgtactttgccttcacccagccttgcgcctgctgatgccgctttggctgctggacagtgcgttgattgctctactgactcactggacgtattgccgccagctgaaggatggttatgagcagatgcctttatggcgttgacctgggccgcctctttacccggcattcgccaatcccgcgcagccagctgggctatagcgtgttcatgagttcgacggaaaccttcgtcgatcgccgcgaagcctgggcggagaccgacgatttctagctggccctcggcaccgaggagccctgaagccgaaccgatcaggccggttgcggcagcgcgagcaattcgccaagaacctctcgcagccgcggatgctgcggcacccgaatggcgaactcgttctgcaacagggcaatcagctcgtcggggtcgctgatctgccgccgctcgctgtcctggcccaggcgatgcgcggcgtaactgccgttattcaggctccggcgcaggccttcgcccatcagcgcgactttcaactgaccgagaaacggcgagtccttgtgggtcgaaacgaaccagttgcccatctcgtaatccgccgcttcctgccgctgctggtcgaacacataaatcgcccgccattcacccgcgaccttggcgcgcagggtgtagctgccgtcacgctcggtgatgcgatagggctcgtggggcgtgggctgctcatcctcggtatcgagcagcagcggcgcggtgggcaccatgccgccaaagccgacatccgagacatagcgcacgccatccagggtcagcagtaccaggcgatgagtacgcgccggccaggcatcttccggcccgcccatcaccacccgcccggtaatgccgcgtgcctcgtagcccaggtactgcaacagcacctggtacatctggttgagctcgtagcagtagccaccacggccctcatgcaggaccttgcgttccaccgaagccaggtcgatcggcaccggcacgcgcaacagggtcgacaggctttcgaaggcaaaggtgctggtgtggcgcaactgcagctcgcgcaaggtcgccagggtcggcggcggcgcgctgtcgtagccgagccgttgcaggtaaagcgcgaagttcatcaggtggggctgactcatggggtggtccttatgcatgaggtgtcgcgtatcggcgctatgtataagccattaaagccccgaaccgacaattgatttggccaatatcccggctcgaaacagcctaccaatggaccctgccaaagctccggcgattatctggaatagctggacgatgctgcgccctgtcttgatccgacggtatgcgggcgcggttcctggcggcgcgcggaaatagccgcaggtcagcgatccgaacgggccaagggctcgttgacgctctcgatcgccacctgattgcgcccggatttcttggcctggtacagcgcggcatcggcgtgttcgaggaacgcttcgatgctgtcgtgcccgttcggcacgaagcagtagcaacccaggctgagggtgactcgcccaaagggcgagccggtatgcgtgatatttttctccatgacaccgcagcgaatctgctcggccatggccagcgccccgtgcatctcggtatcgggcaacaggaccacgaattcctctccgccataacgcaccgccaggtcggccttgcgctgacagcaatccctcagcacctgcgccacctcggccaggcactgatccccggcgacatggccgtaggtgtcgttgtagcgcttgaagaaatcgatatcgagcatgatcaggctcagcgggcttgcctgccgcccgccgcgcccgaactcggtctccagcgcccgctcaaacagccggcgattggccaggccggtcaggctgtcatgggtcgcgatcacctccaacgccgcctgcgcggtccgcaggtcggcctcgatgcgttcgccattgcgcacctgatgcacaaacacccagccgaacaggccgatccccagaaccaccagggcgacaatggcgctggactggtaggcgctggcataccagtccttgaggaccgcatccttcgagctggccgcacccaccaccagcgggtaagcctccagttgccgatagccgtagagtcgcatcttcctgtcgaccagcgaacgaatcatcgcagtacccgaagaagactcaggcaagtacttgctgaaaatctccccgcgcgccagggatgcgccgatctgccgctcctccagcggacgccgcgccagcagggtgccatcggacagggcgaggaacatgctgccgttgtcatcgatgtcgaagcctttgaagaaccggtcgaaataggccagccggatgccggccagcagcacgccttcgaaattgccctgcttgtcgttcaggcgccgcgtcagcggaatgatccactcgccgttttcccgactgcggatcgcaggcccgacgtgggccagcaaggaagcgttctgctgatgaaagcgaaaatagtcacgatgggccacgccttcgctgcgtggcaagcgctcgaaggaggtgaccacccattgccccgtccggtcgaacaggaacaagccatgcatctgtttgagcgcttgcgccctctgcgcaaagatcttctgcaggaaaggcttctgctcagggccataaccatccttctgaatccagtcggccaggctggccagcaccaggtcggcctcgatgaaggtgtcctcggcctgttgcgccatggcccgggtcaggttcgacgaggcgacctgcgcccgcgccatatcgtagtgataggactgcgccagctgcagataaagcaggccgcacaggcacaggcaaaccatcgaaatgaataccaccgcggccttgagcagcggaagccgtttcaaggttcgatcggaggcatggtgagggtcgtgaatcgggataggcaaagcatcatcctggcagggtaaggcatccaatgcagccgggccggccaatcctaagaggtaatagcggacaattcagggtggcgtcgtctgaaaatgtagagcatttttctgatgctcatcagggatatataaaaaacaccctgtcacaatacaaacatcggcatccagcagagggtcatgaatcgctggccaccctccgccaaggtaaagtaccttccgagactacacttaccctcacatcacgataggaagtcggaatgagtaaggtcgatgaactcgccgcaaggctgaaacaaaaacaggacagctgggccaaggaagacatctcggcagacaaggccatcgagctgtggcctgcacaggtctatgagatgtaccaccaggtcgagacctggctgactccactttcagaggtcgggctgaatatccggcgcgtccccactcgcgtgttcgagagccacccctctggcgccaccttcaactatgccatcgatcaactgctgatcgagggcaaccaccagagcatcctcctcgaccccatcgcccgcttcaccacgggtggcgccgggcgtgtcgaaatccacggcaaaggccctgaacgctacctgctgcgcaacggcagcgaacatggagaggggcactggctgatccagacggttcccggctccggtaaatccaggccggacccgctcgaactcaatgaagacaccttgttgtccgtgatccaggaaggcctggatctctgaactccgctcaagcgactgcccctccggcagtcgcgccgctgaagccgacggctagagccgccgcgccgcacaatacgccactatcacctgggacaacgcagccactatgccctgatcggcgtccttggccgtgaacagccgaaactccgcgtcaggcagtaccggcaaaccatgctcagcccccaataccgccagcccttgccccagctggctggtggctatcggcgccaccgcgaacccggacagggccgccgtgcgcaacgccgcggtgctcgagcaaagcattgccgtgcgctgggcgattcccgcttgcgccagatgctgcagggctaccgcccgataagggcatggctcgggaaacagcgccagtggcagcggagtcggcaagcggccgaccaggtacgcggaactggcccataccaacggctcctgccacaacagcaggcccggctcacgggtttcacacagcgaacctatgaccacctcaaggccgccctgctgcatacgctccagcagcgtgccgggaatattcacctgtatgtcgatttccatgcccgggtactgcgccgcgaactcctgcaaaaggcgaagcaggcggggctcgataaagtcctcggacatgccgatccgcaccctgccgtgaaacggcgaacgcgtcagctcggcccaggcatcgcggttcaaggcgaggatggctcgcgcataggccatcaggcgctcgccatcggcggtcaagtgctgggaacgcgtggtacgggtcagcagcggcttgccgacctgctcttccaggcgtcgcagatgcccgctgaccgccgactgggtcaggtgcagccgttcggcggcacggctgaagccatcctcgtccaccactgttacaaaggtcttgagtaacagaacatcgaacatataaagatacgtgatcaatcagccatttatttacgatttatattccgcaaagcgctatgttgcaatgcccggcattcctcatccgagatgccgtcatgacccgcctgctgcatatccaatgctccccccgcaaagaacgctccgcctcgcaacaaatcgcccgaggttttatcgaccgctatcagacccaccatccacacaccgaagtcagcaccctggacctgtggagcctggacctgccggaattcgaccagcacgccatggacgccaagtacgccggcctgcaaggcatggccctgtcccctgaccagcaaggcgcctggaacaccctcgaaaccctcgccgcccacctgcaccacgccgatctgctggtactttccgtccccctgtggaactacagcatcccctacaagctcaagcacttcatcgacctggtcacgcagaaagacatcctcttcagcttcaccgccgaacacggcctgcgcggcctgctgcacaacaaaaccgcggtcgtcgcctacgcccgcggcctcgacttctcgccgctatccgacacgcctgcggaacgctttgacttccagaagccctacgtcgaggcctggttgaagttcgttggcgtcacccaggtccacgcgctgatcgtggaaaagaccatcctggggcatgaggtggatcaggtggcgcggcaagaggccgggaatcgggccagggagctggcggacagcttcaagtgattcaaatgcagcgaacattcgcctcgccatgcggctatcgaatcacacacaaaagcgggcgaccttaagatcgcccgctttttattagcctaccctgttgaatcgccccgggtttcgtggaggcctcaactcttgagaagatgaggccatgagaaagactacgacctattcccctgaagtccgtgaacgtgccgtgcgcatggttctggagcacctgaacgactacccgtccgagtgggcggccattgaggccattgccccgaagatcggctgtgcagcgcaaacgttgcatggctggattcgccgtcatccaaccgatgccggtcagcgtccggggccgaccaccgaagagcgcgagcgcatcaaggctctggagcgtgagaaccgcgaactgcgcaaagccaacgagatcctgcgtctggccagtgcgtattttgcccaggcggaactcgaccgccgtaccaagtcctgagggccttgtcgaccagtaccgtgaccgtctcggggtcgagtcgatctgccgtgttttgcagatcgccccgtccggttaccgcaggcatgcggcccaactacgtaaaccctgacttgcgttgttgccgtgctcaacgcgatgaggtgttgagtctggagatcaccagcgtgtatgggataccaacatgcagtgctatggcgcggtgaaggtctggaagcagctacagcgagagggcattgggatcgccagatgcacggtggagcggctaatgcggcaggcgggattgcagggtataaggcgcggacaggttgtgcggacgacggtggccagcgacaaatcgctgtgtccactggatcgtgttcaacgccagttccatgccgaccgtccgaaccagctctgggtctcggactttacctatgtctcgacctggcaagggtggctgtacgtggcgttcgtgattgacgtctttgcgcggcgcatcgtcggctggcgagtcagtaccagcatgaagaccgacttcgtactggatgccctggagcaagccctgtatgcccgccagccacaccgtgccgatggactgattcatcacagcgaccgtggcagccagtacgtctctattcgctacaccgagcggctggcagaggcggcattgagccctcggttggcagcaagggtgacagctacgacaatgccttggccgaaaccatcaacgggctgtacaaggccgagctgatttaccgtcaatcatggaagagccgcgaagctgttgagatggcgactttgaaatgggtgcactggtacaaccaccaacgcctgctgagctcaatcggatatatcccgcccgcggaggctgaggcaaacttccaccagcaacaagcaggtcaggccatggcggcctgacttaaacgaaacggcctccacaaaagccggggcgattcatgttcatacaaccgaccggaatataggaaccgaagacccttcatcttcctggtgcgcgcgcccttgcaaccccggaactccattcctgataaacttcccctccttcgcctcacccatccagattgcccaatgctcttatctcctgctccaactgcctcgccagccctctcccgccgcttctccgtggcgccgatgatggattggactgcttcttcttgaacgccgctattttcagagcctccaagtcagcatgttgagctgagtaccaattttgtaccattcggctagcagtcacgccctcagctcacacttatggctggagtcgtcaggcttaccttgcaatacctggtttaccacttgctgaacttgctcatcggaaatggtgcgtggccggccagagcgtggttcatcgttcaagcccagcagcctcaatttagagaaacgctggcgccatcgtgacaccacatccttgctggtacccaagcgctgagcaatgtcgttgcctgactcgccggctgcacaagcgaggattatttcggcgcgcaggcgcgcatcctgggcgcctttgcggagcttgatcaggcgtagcagctccgcctcttcggcttcgcaaagggtaatgacagttgctggtcggcccatgtcgatacacagctcttgatgagtgagttctatagagcgcagaccagtttttcagtggtacttctgaagcaccacactagtttacatcaggcgatattttcgacattacttttgtcacactgcctcggcagtctgaattcggacttgatattgttaagcagaaatatttgatataaatttagcatacacccacacaatattacatgaatggttgagttgcctgataaaccaaaattaccatttccggcctacagcctatatgtatgatcttaaaattaataaggaagccataagcgcaaccagaaagttaacggtagacggttgcaaaaacttagtatactggacatataattatgccaagattttttgaattattgaaatcgagcaggaaaaaacaaagcaaccaatcagcacctagctcatctgtcaccttcacggaaggccctattgcagaaggtggggctgaaagcgagacacctgctaaaatgcctttgaaaaaaaagctcacggttacagatcgagatctttctagatgtcgcgacatcaagtccatgggcggcacccataacgtaaagcgttattgcctgccagaccaagtctatttgatttccaaagatattccaatatgggagccccattctgaagagacagtgcaaaatgaaatatttgcttataagtttagtaaaaaattgaatttaggactagtgccagaaaccacaaccgctcaaggaaacaatagaaaaatcatctccagatacataagaagtcgccccgcaggtatcgataaattttctcgccctaacgataaaatgttcttatttgattacttactaaataccggagacagaaacaatcacaacaaccacaatgttattgagggtgccgacggaaataattatgcaatagacaatgaaagcatattgggattagctgtcggaggcaactttgtcaccgaaaaagatatcaaacaagaacatattgacttattcttcaaagacgatcaaacaaaaataaagttcatgctgactgattgggaagcttttttcaacaagcatgctcccaacagggcgtccgaaagcaaaatagaatttctaaatagaattgaatttgttaagcagcagataaacaacaattgacatcaggcatccgctggataaacaagttcatccgccgtcagcgcttccaagcgctacacctgggctacagcatggggagaacctggctgacctggttccccttcatcgctcgggggcgtgtcgtggccctgcacgcctacatattgtcccgggaaggctgcgagatcctggcgaacactccttagagggtgtagacagaataaactaaagttaccactccttctgcctggacagcctcgaagtcatgcctagaaccggacgcccacccgcgattgccgcagagcagtacccaatgctagtcaagctcgcacaagcccatcccttctccagccaagccgaattagcggatgcatttcacgctgaaacggggatcaccgctcatcccgacacgtttgcaaaagccttgaagctggcggggattacacgcataaagcagcgcgccaaaggcagctttgtgtcatccgaacttcgcaagtcctatggctacaacgaaacgcaccgacgccagttaccggagcaacgatatcccagctgcttgactgatgctgaatgggcactggtcgccgatttgtttgaaactcagggcggtcgtggtgtgccgccgcgtcattttcgacggacgctgctcgaggcctgctgctatgtagtacgcacggggtgctcatggcgcatgctgccgcgtgagttttcctcactgggacaatgtttacaagaccttccgccggtggagtacgcagggcaagtttgagcagatgcatgatcgtttacgcgcgcaatggcgggacagggaagatcgcgatgacgccccgtcagcggctatcttagattcccaatcgactcgcagttcccctcaaggcggggatagtggcttcgacgctggcaagaaagtaaaggggcgcagcgaagtctgatagtcgatacgctgggcctgcttctggcggtgagtatcagcgcagcaagtgtgcaggatcgcgacgcagcggatgacgcagtagcttactcgaaggaaaaatacccttcattgaacacgctcttcgtcgatagtgcctacgcgggaaaatgggctcagcgcatgcatcaaacgcacgcggtcgacgttcaagtgatccgggggccaaacaatagaagaacggggcaatggcactcagaacagggagatctgtttactgtagctcctgcacctaccggcttcgtagttatgcccaagaggtgggttgttgagcggactcatgcttggaatgagagggctcggcggctaatcatgcaccacgatcggctgctcgccgtgagtgaagcgtgggtgtggctggccgaggcacgcatactcgcgcgccgactcacgacatgattttgtctacaccctcctaaggcgccatacgctgctgccctactatgaaccgtttttgacacaacagcaggtgaacgattaagcagaagcccccgatcagatccaaccatcaggccgctgaacaatggccaactataggaaaaagaagtctcaacactgaagtaaaaagagcggctggagtggatgcgtcaacatccagtccggccgtcgtctctagcgcagttaagccgtgttctgtttggtccggtctaggacattacgtgaccatcggcattggttataagtacacctaattctgttatcacctggccggcgcgagtaaatggtgatagtacgacaccctcaatgtcggttggtgaatagtcgataacgaagttcacttgctcaccagtatgggttatctgggcatcaatttgagtattaccatagcaatctcgccctattcttatgttatttataccgtaatgtgtcgttggacgcctcaccgcattagttaacgatagcgtaaacgcgcgccagtcactactattcgcatcgccatcacacataactgtaatagtaaacatttgtttgaagggcgtagtcgtaccatttgacataatattgaattgtgcataagcattttgtgtgccttccaaaatggttgcaatatttttccagattactgatgatgaagtactgtttccgagcaatcttactctgctcaatacggtgttcgaaacctctaatttattactgaccacgttcagagttgaaccgtaattgataccaacccctccactatcgactaagatcgccctgcctgcgttggccttaacgctaacaccttcggtgcctaaattgatgccattagccggttgaacggccagaccattgcccccgacagtaagccccttattagactcgaccgtaacacccacgcccgtggtgctgagattaatgccgctacccggttggacggccagaccattgcccccgacagtaagccccttattagactcgaccgtaacacccacgcccgtggcgctgagattaatacccctacccggttggacggccagaccattgcccccgacagtaagccccttattagactcgaccgtaacacccacgcccgcggcgctgagattaatgccgctacccggttggacggccagaccattgcccccgatagtaagccccttattagactcgatcgtaacacccacgcccgtggcgttgacattgattccaccggcagcctgcggcagtaccgccaactttagattatcatccaaatacatgccattaccttggccaggaggttgatcgggtgacaggccagctgcctttcgtcctgcatcggcgacatcgatcaagtcggaaaagtttgatgccagtggtactttttgaacaccgaaaacatccttgagtctttctgttggagaacctacggacggaattattttagacattgtaatcaccgtgaaaacaattgtttgaacgaatgatgcatgaattgatagttattgtagatgggcgggcgggcggttctcaatactttattaattccgatatcggactgcgaacagtatttaaaacactgtaaaaattgaagatttttgatttgtttattaggttgagtaagatttttaagtagaagtcagccatgcgctcgtactcttcgaacgggaagtcgaacccgtagccggcggtctgccagtaaggtgggtccatgtagaagaacgtgtgcgctcgatcgtagcgctcggcacagtcaagccaagacaggttttcaacgtaggtgccggcgaggcgctgccaggcagccgacaggttctccccaatgcgcagcaggttgatggctggcccggtggtggcggtaccgaatgtctggccagtgaccttgctcctccaccggggcaggctgcgggcgcatgaagtacaacgcggtaccgcctgcgaagacttcgacatagcattcatgagggggaaagagagggatcaagcggtcggccaggcggcgcttgccgcccatccagggaacgataggagaggtcattgcttgcaagtctttactgtatagataaacaggtgataggctcgccgcgctttgtgcacaaggcagaggccacggctggacttgcaggaagggtctgcgggttcggcgggccgggctggatgttgacgcatccaaccggctcgcctctttactacttggtgacttcgcggacgtaggcctggcaggccttcaacgcgatcagtcctcgatcgccttcgtcggtgatggcgataattcgtcgagcatgcggtgggtcaagttgggcgcgtacggcttcatccaccatgcctgcggtgccggcgggcgctcgcaacccaccgtcactaccctgggtggcaacggttccggtgtcgagtaggactgacagccgcagatcagcagtagccagccggtcgcgcaggcgagcctgagcttgttgagcatcgttcatctccttccaatgggtttggtcctgcacctgcaggcggtcttccagggcgcgccgggctttctgctgctcctcaaactgagcgagcgccgccaccgcggcgtcctcccgctcttgactgtgcgccagatcttttgccgcaagctgttgctcataccctgccgcttgcctttccagctcaccggcctgccacaaccacgccaggcgcgcaccaaccgcagcgccgaataccagggccagcgcgccccacctccagcccagggacatcacatcagcacctgctcggcacgcttgtagatcgccaaacgatcatccagcccgttgaggccaccgttgatccgtcgggtgatggcctcgaacgccgacggtcccttgtcggccagcgagttgaggccggccaggtgccagaaccaaccggccgagtcggcagcgtgcgccggacgctcgagcagttcgggatggttgagcagatcgaggcccagcgcttcgccgcaacgctggtagttggcacgaccggtcacctggatcaggccacggccgcggtacttttggccatcgccgtcggcttcgagcgtgttgcccagctgcgcagcgagcttgccggtgtcgtacttggccaggtactgatcgccgcccagttcacggacgtagcgcagctggccagactcatggccgacctgggccaggaacgcacgcttgcgcagtggggtgacgatgccccacttcaccatcgccgcgttcagcacaggaagaaaaacgccggcttgagcgccggcgttggggaggatctgttgtagttgcttgagagtgacagtcatcttgaatctccagttatggccactcaggccggtttcacatcgaccaccttcagtggcgtgtcggatttctttttcttgcccttggccttcgccttgcccttcttgccgccgttgcactccaccgcggtcgaccagccggaggcatcgaaggtctgctcgacgctgtcgaccaggtactgaccatccagacccaccttgaaaccctgggcgttgattaagcgctcggcgaacaggtcagtgcgcccgggcatctgcaagcgcacactggcagtggtgcggttgaacgcagcgagcttcgccttggccgcctgttcggctgcggacttgttcgggtagatgtgtcgatcggtgtacgcccggcagccccgatggggcgtcgtcgttacccagctcgaccaccgtcaactttccggtctttttgtcctggtgctgggtcttcacggccttctgtgcgctgcggtccccgagacggaactgccaccggctcacgtccgcaggcgtgatagtgaccacgccaaaggccttgccgctggccccctggctggcctcacggggcaggaccagcagcttgccgtcggcgaccttcgccgtgcagtcgtattgcttggacaggcgggtgatgaagttgaagtccgactcgttacgctggtcgacgcggtcgaccttggtctgcacggggcaggccggcgcccagccattgcgagccgcaatgtcgcggacgatctgcgacagcggcacgccttcccagttacagctgcgcgtggtcttgccgctgccgcgcatgtcgctggccttgccccggatgaccatcgtgcgtggcggcgaggagacttcgatctcgtcgacggtgtaccgcccgaggcgggccagcgcctgccccacatagcccaggtaaacctcgatccgtgcccctcgagcgggcaaggccaccgctgcatcgcggtcatcgatccgtagttcgaactcgtcggagtccatcccaggcttgtcggtcgttctcagcagcaacaaccggtcactgatcagcgccgtgatgtccgcgccatcagcgacgatgcgaaaggtaggttgcataggcactccagaatgaaagagccccgcactgggcggggctcgttgagggctggggttctgcatgtcgttgccatacttcacgaacgccagtgagaaaccctgcttgcgtgggatgccgccagccaacagcgcgccctgctcttcatcgatgctcagcaagcaccaggtaccgagcacgtcgccatagcccgtaaccaggctgacgggctgcaaccggcggacgatggcgcgaagggtgtccagctgcttgatccctcccttgaagccgggatagatcacacccttcaacgtgatcttccctcgcccaagccgcaacccaactcggcctcacccggcccaagctcatcgctcgcatgcgggaaaaaggcctgctcaccgagcggaacctgccggcctaccccaactgtgatcgcgactacctgcggatcaaggacggccagtggtaccacgaccagttcggcatgcagtacagccagtcgaccagagtgaaacaacccggcatccgctggctggccgaacagttgggacttgagataccggcaatcccggcagaccgccgtgacgtggcctagggaatacgcccgccagatcttagccctgcgtaccaaagaggagagcaatgccgcgctcctcgaagtaccagaacatctgcgggagctgaccaaacgccactgcctgaacgcctggaaccacccagcacgccaaaaacgcaaggaggcccaacagagccatgagcaataacagccaagcaccgctgcgactgcaccccgcaccggattcatccaccatcgaggctctatcgaaccttcggtgatgtgctgatcccccttgaaaggctgcgcgagcagtatttccgcaacctcaacaaggagtcgtttgcagccgagatcaccagcggccgcatcgaaatacccgttaccaccctggacagcagccgcaaggcaccgaaatacgtacacatccgacatgttgcagcgctgatcgatatccgagcctacaaggcggatgaagacatgccccgcacacaagacgaaacaaacaagtaaccccaaagcacggccgccaccaccggcccgcacaccacaaggagtaacacccatgaccacccaacaggtcatcgccctcgccatcatctgtgcgttcgttatcgggctgttcgcctatgcctactggtttggccgccaagaggaccgcatccgaggccgcattgccagcgacctcgagcacaaggcgactatccagcgactggaagcgtccctggagttcctgcgcaacgaccaccggcacttggccgcacacgcaaagcaactgaaggatgcaagcgcactgcaggagcagcaccgccgcaccctattacagatcgccgaaagcctgcgcattgccgccgagacctggagcgccttcaagacgggcaagaagctcgagcgcgacgcacaccgcctgcgtaacgaagccctcgccctcgccgacctcttgaagcccaccgaacaggaggccgcagcatgaatcaggcccaccaccccggcttgctcttcgattctgtgccatgcgccagacacacccgcgccatcggacggggatcaacgcagctctcgacctcggaggaaagcggctacgcgcgtgctcaggattgcgacgccacccgccccgctttactccgcgaacaggcatgcatcgacgcgcagaaaacaaagagtctctgctgcgcagcagcaggcattatttcccatctcagcagcaccacagaattgctgataccccacgacaggctgcgcccgctgatgcaacgctgatcgcttcagatcgcccgcacgcgcagcctgttaaggggtatacgccctcagcagccaccattcgtgagtgcaccttcgagactatcgacgccaccgccatccggccggccactggcacgttaccgactgtttacaaaatatccggctatgaacacctggccctgaagccgaactctcgccgcgcccatgagaggtactcgctgtgaacaccgctttcgtattgatggcgcagtacaacgggctcgccataattccactagaactagtatgtaatgactactttaaacatctcacacctgaaatgttccaaagaaaagtcctggccgggcaaataaaaataccaataactcgacttgagagcagccaaaagagcgccaagggcgtccatatcagcgatctggccctgtatatagagaaacaacgctctgacgcgctcaaggagtacgcacagctaaacggtattcgaattacaagctaaaactagcggcacctgcaatatcgcggcgccatcaaaacattgtcattgcgtcgcaaaacataatagaatcgcacaattttttgagaattcatcatgttgacacccctacgctacccaggcggcaaagctaagctaggagcttggctagctcacctccttcactcgaataacatcaacggatcttacatcgaggcatatgcaggaggcgcaggcgcagccatatatttactgagcaataattacgttaaaaacatcataatcaacgatctcgatcccgcaatctatagcttttggatgtcagcgacacacaactccaccagcttcattaagaagataatgaacactgaagttaccctggaggagcgcgaaagacaaaaagagatttacaaaaatccgttcaagcatagcgaacttgaactaggattcgccacgttctttctgaaccgcaccaatcgctcgggcatcatcactggaggcgtgattggcggaaaaaatcaaactggcaaatacaaaattgatgcaaggtacacaaaagaaaatctagcagaacgcgtcaaaaatatcggtaacatgcgagaaagaatagccattcactgcgaagacgctcttcacttcttaaaaaacatcaaaaccgatcacaacagccttataaaccttgacccaccctactacaacaaaggcagccaactttattcaaacttctacaagcacgaagaccatataagcatctcaaaccagatacataaggtctcaacaccactaattatcacatacgaccattgtgaagagattcaagaaatctatgaagaccaccaaagcctgaccttcaacatcgtatactcaagccatctggagcgccctgtagctcgcgaactcttgatatataagaatattaggattgatccactcccattcacctcgaagcagatcagccccataaaagtcaagccagcccctactccgagacgatctcaccccacacaagcttaaggagatgatagaaatcatcccaagtattcttcaccgtatcatcacgcggattaaacatttccgaatgtatatatttttgcatagaaggaattgagaggaactgaccattgagaagatcttcaatcttctgatagtagtcattcccctccgaaatccggccatccctgaccagtttgttttttatcaaacgaagcatatccttaatggaaatgctatctacactccctcgccctagctgaaactttacaacataagctctaaacgacccttccacaaatgcccgcacaagcatcattccagcaaccggacacttttcaagcactgtgagctctttgtagatatccctgagctttaactcatctttaggcaataccagtggatgacctcccttggttacgtacttagcccgattggcgctgtgcgtggtaggcatcgaaccattttttgctccagagcccgaaggggaagatgtcccaccggtagcattacttgcagcagcccctaagccattgcctggtcgctggccaccgccaataccgccttgacctgccacacccgtttgcggcttatcggaggcttttccagtctcagcgcctgggctttgaaggggctgacactcatcgagacccagctcacgcctgaccacttcaatgtagtgttcacgccctggagctgacatcatcgagaaagagccattctcctcactccttttaacgtggacctttccagtttgaaggtcatcaatcaatctcttaacaacggctagcgcaacaataggagatgcctgtacttcaagctcatcactttcatcgaagtcgaagcctaaaagcctaatatttttctgagcattgaaataccgacccatggtcgttatggcaatgtcttccggtacttcaatatcattctgatcagcccacaacaaaagctttgcagcccgccaatagttacctttctcaccgatggacagctggtagtattcctgctgaagcgacccccattgcttgcgtcccacccccccattttcaccggtatgaattctggagatatactcattaaccgcctctgcatcctcacctatttggcagtcaacactataagtcaggttacccttttcctcagccaaacgagcaagtcgctcaaaacgatcctgcacgcttttttcagcacacaaataaggcctattgagcaatttcaaagcagagatacgccgattcccatcttttacaatgagcttgtttcgttgcttcaaaacaacaataggttcgatggtgagaccattttcggcgatatctttcgctatagcgaaaaaggacgccccaaaggaaatcattttagcgagacaggtaccttggtcaggcgcatagcccaaacgaggattatgttcatcgagcaaaagcgaatcaagcggaacattttttttgtccctgaaaccagttctcattccacaagcgctccaatgtccggtaataatggcactttgtcctacgctggagcataccggtacacctcccacaagaacaactattggatccagaagactgaaagactccgcaccgaataagtcaatgttttttagagaacctctgccctgcaccctagcgccacaggggactgaagaatgcgatccagccagcgccattggacgtatctatcacctcttcccctcagatgggtgtagcgccgaagcgagttccaatcccggtgcccggaaacacttgaaaccctcggtatatcccagtccatttcaaacagccggcttaccccttcatggcgtagatcatgaaagtgcagatcttcgatacccttcatcttgcatgccttggcccaagcagtaccgaccgagtcagtgttgtacgggaagatctccgggcattcacggggcatactctgcacaatctgccatgcctcatccggcagttgacaccagacatcattgccgatcttctggccgggattcttcatatcccgcaccttcaccgcctgccgatgctcatccagatcgtcccagagaatgcgggtgatttcgtccatccgccgcgtcgagaagatcgcgaatgccattaccttgggcatatgaatcacggtgggtcgacgcttcaacatctcgaagaagtgttccagcaccttatcgagctcatcaagcgttgggcgccgatcccgctctcggctcttcattttgtagccgaactttttcagtacgaggcgagcatcaggcatcgcctgcggatcgatctcatacccccaagccgccctggccaaagacaacactgagcccaggtgagccatgtcattgccggcagtctgaggcttgaccgagccaccctcggggctcatgccccagagcgcataatccactagcacctgctgactgatgtcggagtcgaccttttcacccaggtaactgttcttgatggcgttgagcgtccgccgcttggtctctcccagcggccgggctttctcggcttcgatcagatagcgatcgatcatctgcttgacggtgtgacctacgcggctggcccgcgcgatcgcaccaggctctgccagctcggtctcccgtcgctttgcccaggcctgagcagcctgtttgcgggcgaaggtttggctctcttggtagactgtcaccttgtcgcgattgatgcggatctggacgaggtagctcagggtagcatcggcctttttgcgcgttctaattgttgccatgtgagaattggtacacgtccgttgtcgattggtacattgtgccaaccactaagtaagaatgccccaaaacccccagtaatcggtacgaaacacgttgaacgaaaacactgcaaaatcaagctcaaagccacataccacaaggcctgagccctcccgccgcttttccgtggcgcccatgatggactggactgaccgccactgccgcttcttcctgcgcctgctgtccaagcacgccctgctctacaccgagatggtcaccaccggtgcgttgctcaatggcgaccatgagcgttttctgcgtcacgacgagtccgagcatcctttggcgttgcagctaggtggcagtacgccggcggatctggcggcttgcgcgcggatggcgcaggagcatggttacgacgaggtgaacctcaacgtcggctgcccgagcgatcgggtgcagaacaatatgatcggcgcctgcctgatggggcatccgggcctggtggccgattgcgtgaaggcgatgcgcgatgcggtgagcattccggtgacggtcaagcatcggatcggcatcaatggccgcgacagttatgaagaactgtgcgatttcgtcggccaggtgcgggaggctgggtgcaccagttttaccgtgcatgcgcggatcgcaattctcgaagggctgtcgccgaaggaaaaccgcgacattccgcccctgcgttatgacgtggcggcacgcttgaaagcagattttcccgagctggagatcgtcctcaacggcggcatcaagaccctggaggcctgccatgagcatctacagactttcgacggggtgatgctgggccgcgaggcctatcacaacccctacttgctggccgaggtggatcagcagttgttcggcagcagcgcaccggtgatttcccgggccgaagcgttggcgcagttgcggccttatatcgccaggcacctggccacgggcggcgccatgcaccacatcactcgccatgtattggggctgggcaccggttttccgggggcgcgcaagttccgccagttgctctcggtggacattcacaaggccaaggatccgctggcgttgctggatcaggccgggcagttgctcgaaggtcgctaacggtcgctcgggttgaacctgatgggtgttttggcatcgtagtaaacggatagcgccccagcattcaaacacctgtttttcaggttgttgcccttggggctcgtttaggcatccggttacgtattcgcgcccttgagcggctgtcagcgctcgggtaatgtcaacagacccacaggacagagcacactcatgacttccaagctggaacaactcaagcagttcaccaccgtggttgccgacaccggtgacttcgacgctatcgcccgggtcaaaccggtagacgccaccaccaatccttccctgttgctcaaggccgcggccattccgggttacgccgaactgctgaacgcctgcgtcagtgacgtcaagggcgatgtcggcctggccagcgaccgttttggcgtcgcagtgggcaaagaaatcctgaaagtgatccccggccgcatttccaccgaagtggatgcccgcctgtcgttcgacaccgctgccatgctcaagcgcgcccatcgcctgattgagctgtacgacaaggccggcatcggccgtgaccgtgtactgatcaagatcgcctccacctgggaaggcatccgcgccgccgagcagctggaacgcgaaggcatccagaccaacctgaccctgctgttttccttcgcccaggcgatcgcctgcgccgaggccggggtgttcctgatctcgccattcgtgggccgcatctacgactggtacaagaaagccagcggcaacgactacaccggcgccgacgatccgggcgtgcagtcggtgacccgcatctacaactactacaaggccaatgactacaagaccgtggtcatgggtgccagcttccgcaacctgaaccagatcgagcaactggccggctgcgaccgtctgaccatcagcccggacctgatcgagaaactggccgccgacactggcaagctggaacgcaaacttgcaccaggccacactggcgaagctcgccagagcctgaacgaagcgcagttccgctgggcctccaacgaagacgccatggccaccgaaaaactggccgaaggcatccgtcagttcgcccgcgaccaggaaaaactcgaggcactgctggccgccaagctctgatcgagcgagcgccaacgcaaaaagggcgaaccctcacgggttcgcccttttttatgtgctgccgctttatgggatcagttgcgttccagggcattcaccagatcgtggaaagcctcgcggttggagtcgttcaagcccatgaggatcttgtgcgcctccagcaccttgagccgcaccacctcttccgactggtcctgggatggcaggtcggtcaggcattccgggcatgggatcggacgatcaacgatgttgaacacctgatcgaagcccatggactgcagtagtcgggtgatgtcttcgtgggtggtgacgacggtcggcaacaggccgaccttctgccgcgacaggatcgacagcttggccagcaggcccagggtggtgctgtcgatgctgcgggtttcggtcaggtcgatcacgatcgccgagaagttcagcgccgtgaagatccgctcaatagtcgcatccagcgccgaacacagggtcaggcgcacttcaccgataaacttcaggacaaaggtgccgtcctgctcggcgaactggattctaccggtactcattaaagattcctgctcaacaccaacagggcgatatcatccggcatctcccctagcgtggccaatccaaaaacctgccgcagaccatccaggctgccgccggccgttctcacccgatcaggtaaggcggcctctttctctttgagtgtgggttccggcaaaaggtccagaatgccatcagacatcagcgtcaagctgaagctcggaggaagttccagaatgtggtcttcataggtggcttcattgaacaagcctaccggcagaccccgcccttccaggtaacgcacactgtctggcgtgtacaacacaggcaatggcaggtgtccgccaatgctataggtcaacaagcccgtctcctcgtcgatgacgccaccgaccattgtcacgtgtttgcccagcttacagctgatcaggccacggttgatatggcccaggacttccgacggcttgaattccggcaaagtgccgttgcgcttggactcgaacagcaagcgcgtggtcatgaacttgagcagcaccgtgacaaaggccgaagacgcgccatgcccggaaacatccgccaggtaaaaggctacgcggcgctcgtcgacacgaaagtagtcgacgaaatcgccggacaggtacaacgacggaatgatctggtgcgcgaacttgaactcatcgatggtccatgggctcaccggcagcatgttcatctgcacctggcgcccggcgttctgatcttcctgcagcaggctcaggctggcttcgagctcgcggttggcggcttccagcttctcccggtagcgctggttttccagtagcaggcgcgcacgatccagggcccggcgcaccgagtgctccagcaccgcgaggtcttccagcggcttgatcaggtagtccgccgcgcccaggcgcaaggcctcgacggcatcgttcatcacaccggcaccggaaaccacgatgaccggggtttgcggttcgatgtcggttacctgacggataagttcgaggccgcccatctgcggcatgcgcagatcgcagatcaccaagtcgggcttttcctgctcgaacacctgaagtccctgctgaccgttactggcctgcaggacgctgaagccactgtcttccaaataggccgcgaggctcgcgcgcactacttcgtcgtcatcgattatcagcagcgtggcactggtttttggcatgtgggcaaacggcgccagaattaggttggcgtaggtggctgggcacgaggcctggacacacactactggattcgctttctagccactctggaaatggagtcagggcccgtagccctgcacgctcgaccatcagaggtgcccttctaaggcgcagacggtactcccatccgcggggcgtttcaagctcatgccgatggtcgctggacgtctttacacctcaaatcaccgggagttataagaacaggcaaatccgcaacttaaacgcaggttggagcctatgagcccaaacgatcgtgactacagtgaaaagcgcgattacatccgcatgcgagtggatgcagaggtcacgctgatccaccagggccaggtgattgcggccgtctgcatcgacctttccagcagtggcatgcaggtccgggctccgcgctcattcaaggtcggcgatcagctcagcgtgcgtatcgattccgagcacgccgccctcaggggactggaagcggacaccgaagtggtctgggtcaccgagctggaaggcaaaggccagaaacttggccttacaatcctgaagatggactgattctaagatcaacaaaaaaggcggcccccagggccgcctttttcatggacaggtcgattaaaaatcgtcttcgaccttgccgtccttgaccttgaattcgcggttctgcaggtacgcattgcgaatgaaggtgtacttgtcgccactgatcagcttctcgctcgacagcaggctggcgcgggtgtcgacaaggtccagggcaaacgcgctgttgcgcactggcacgtcattcacataacggtaaggttcggtgaagctgtccacatacttggccggcgcatcgcgcagggtgctcggaccgaagaacggcaacatcacgtaaggaccgctgccgacgccccagtaaccgagggtctggccgaagtcttcatcgttacgctgcaagcccatcttggtgctcacatcgaagaaacccgccacaccgatagtggtgttcatcaacagccgcgcagtgtcgacggcagcggcatggggcttggcttgcaggatatcgttggccaggttgccgacatcaccgatattacggaagaagttgtgaatgccgtcttcgagaaattgcggcgttactgcctgataaccttgcgccagaggtttcagcgcataggtgtcgatggtgtcgttgaacgtgaagatcgggcggttgatgctttcccacggatcgtcttccgcagcgtgggccaaaaccggcaccagcagcatgccggcacacataagctgagcgagacgattgctccagcgcatagcagaaactccttggattgtactgtcgcgggcgctatgccctggcggtaagcgcgctagtataagtcggatatatccatttatgcagcactggtgcagtgcttcgccctctccccctcgtttgcatggcctgttcacagggatgtcatccaacggtcatctgtcgtcgatactcttgcaaggtatttcagggacgtcacgatgcctcacgccgaagccttgcctgtatccgcccccaccttgaccgccgtgctctttggcctcagcggttgcctggtggatttcggcgcgcggatgcgcctgcacagcgccgaccacccggtcctggaacaggcccacgccactcacggcgccctggacattctgcacagcctgcaacatcaaggcgtgccttgcgcctggctcgacgagttgcccaccaccctcagccagcacctggcaagctcactacccgactggctcaccccctgccccaacacaggctcccgctggccagctcccgacgcttgctggcaggcgctgatggccctgaatgtcagccggctggacggctgcgtgctggtcagtggcgaaccgcgcctgttgcaatcgggcctcaacgccggcctatggaccatcggcctggcgtcctgcggttcgctctgcggcatgagcccgacgcaatggcaggctctgagccagcaggaacgcgagctcaagcgtggcaaggccaccctgcatctattcagcctcggcgtgcactcggtgatcgaccatctgggcgagctgccaacctgcctgaccgacatcggccagcgtcgccagaaaggtgaaaaaccctgacttgatcaagatcatgcacattgcccgcgagtggattacgctaaggctcagacatggacctttagcgaatcggcgcggtccatggctgagcctatcaatgaagggagaacgccatgcctgcccgcgaactgcaagaacagctcaataccctgcgcgagcaattggagcagaacccaccgctttcggaagcagaacgcgccaatctgcaggaattgatgcaacagatcgagctcgagctcaaactggaaaacgccacccaggacaccagcctggccgacggggtcaacctcgccgtcgaacgcttcgagcttgagcaccccgccattgccggcaccttgcgcaacatcgtgcaaactctcggcaacatggggatttaaccccttacagacaaaaaaagccccgctaccagagcggggcttttcattactggcgaaccaggcggaagttggcgaaactcgcggtttcggtgctgcgatacgggttgatgtccaggccaccacgacgcacataacgcgcatacaccgtcagcttctccggctgcagcaagcgctgcaggtcgaggaagatccgctccacgcattgctcatggaagtccgagtgctggcggaagctcaccaggtaggccagcaggctggcgtggtccagcgccgggccacggtactccaccaccacactgccccagtccggctggctggtgaccgggcaattggatttgagcaggtggctgtgcacgctctcctcgacgatccgcgacctgtcgcattgcagcagttccggacgcgggtgttcatagctgctgacgctgatatccagctcatcgatgcaggtgcccggcaaggccaccacaccttccgcttccacttcgcccaggctgcggatgcgcacgcccaccggcttgccggccgccgcagagaggtcggcacgcaaggtttcctccaggctctggcgatccgcgaaaggagtctggttcagcgagttgaggtacagcttgaacgacttcgactcgatgatgttcggtgagtccgccggaatgctgaactcggcgatggccaccaccggcttgccggagggcaacagccaggacagctcgaagcagttccagaagtccacgcctttataaggcagggtgtcggcgctcaggcccagctcggcccattttgccgcccgcgggattgggaacaacaaggatggcgtgtaggtggagacgtattcactggacttgcccagcggcgaatgttcggctgcgggatgcatggcggaaacctgactgaagaatcaggcgattctatcagtctttgcctccgcctttgagccccaggcgcttactggctgaccgtcagcttgccgaccatgcctgcctgatagtgccccgggatattgcaggcgaactccaggctgccggccttgctgaaggtccaggtcagctcagcggtcttgcctggctccaccagcacgctgttcgggtcgtcgtgcttcatgccgggcatcgcgccatggcccatggcggcgtgatccatggccccggcgggcatgttcttcatcgcggtgggcgtgagcatgccgctctgctgcatcttcagcatttcctgttggtgctcagcatgcatggctgcattgccgaggttgaactcgtgcagcaactggcccttgttgatcaagacgaaacgcacggtctcgccggccttgatatccaggctcttggggctgaacgacatatcgcccatgaccagttccaccgtacgtgtcgccttggccgccggggccgcctgaccgaaatcgtaggtctgcgccggcgacgcccaggccggcacattcaacgccagcagacacgcggccaacgccaatgaacgaggtaaaacacccttgggcaaaaacataatcgcactccaacaagatgaggttcagcttgtgtgaaactctaaggccgcgccgctgccagccagctgaccgctagattacaactttgtcagcttgtgccctgcggtcgtcacccagggtataaagcccgcgttccatttgccatgagccgcccatgaaactgctgatcgtcgaagaccaaccgaaaaccggccactacctgcgccagggcctgagcgaggcaggcttcaacgccgagctggtggccgatggcaccacggggcaacacctggcgttgaccggcgactactccctgttgattctcgacgtgatgctgccgggccgcgatggctggcagatcctgcaagccgtgcgcagtgccgggctggagatcccggtgctgttcctgaccgcgcgcgatgcggtggaagatcgggttcacggcctggagctgggcgccgacgattacctggtcaagcctttcgccttctccgaactgctagcccgggtccgcagcctgctgcgccgcggcagctccaccccccaggaaaccaccctgcaactggcggacctgcgcctggacctgattcgccgacgggtcgaacgcaacggccagcgcatcgacctcaccgccaaggaattctcgttgctggaaatgctcctgcggcgccagggcgaagtgctgcccaagacgctgatcgcctcccaggtctgggacatgaacttcgacagcgacaccaacgtcatcgaggtggcgatccgccgcttgcgcctgaagatcgatgacgattacccgaacaaactgatccacaccgtgcgtggcatgggctacgtgctcgaagagcgccaggcctgatgcgccgcttgtccctgagcggccgcctggccttgttgttcgccggctgcaccgcggtggtttcgttgctcgccggggtgctgttcagccgcgccagcgaggcgcacttcatcgagctcgaccagcaactgctggaaggcaagctcatcgccatgcgcagtgcgctgcagggcgccgacactccgcaacgctttgccgaacgcaaggcacaactgcaggatgaactcagccatcaaccggacctgacgctgcgtgtcacaggggcggatagcgccgtctggttcgacagcgccaaggttctgccggccacttcggcccagccgagcggactgcacagcctgcaacatgacggcaccgcctaccgtgtctacagtgcggccctggagccaggccaggtcggctcgccagagctgaccctgatgctcgacatcacccaccaccagcactttctgcagcgtatgcagcacctgatctggctgaccgtcggcctctcggccctggccaccgcgctgctcggggcctgggccgcgcgcagcggcttgcgtccgctgcggcggatgagcgaggtcgccgcgggcgtgtccgccagctccctgacccagcgcctgccggagcagcagatgcccggcgagctcgccgaactggcccatgccttcaatgccatgctcgggcgcctggacgactccttccagcgcctctccgcgttctcggcggacatcgcccatgagctgcgcaccccgctgtcgaacctgctgacccacacccaggtcaccctcacccgcccacgggcgctggaagactatcgcgaagccctgcacagcaacctcgaagagctgcaatggatggcccaactggtcaacgacatgctctacctggccaaggccgaccacggcctgctgacgccgaaacgcgaagccctggagctgggtgaggaaaccgacatgctgctggagttctatacgccgctggccgaagacgccggtatcgccctggggcgcgaaggcagcgcgaagatccagggcgaccgcagcatgttgcgccgcgccctttccaacctgctggacaacgccctgcgcttcaccccggctggcggcgaagtgcgggtgcggcttggcgagacggccaaggggtcatacctgcgggtggaaaacaccggcgaaggcattgcgcctgaacgcttgccacggctgttcgaccgcttctaccgcgccgacccggcgcgccatgaaggcagcagtgaacatgcaggcttggggctggccatcacccaatcgatcatccgcgcccatggtgggcagattcgttgcgaatcgacgcagggccggacgagcttcgtgattgagttgccgaggcaggaatagcgcagggttggcgagcaagctctctcgtaggagcaagcttgctcgcgatagcgagattacgagtaacgcaatgcagtcgccggctcgaccttcgccgcacgccacgctggatacagggtcgccaggaagctcaggacgaaacccgcggtacagatcagggccacgtcgccgccctgcaactcggaaggcaggttgctgacgaagtacacgtcggaactgaagatgtgctggccgctgacccgctccagccaacccaccagcgcgctgacgttcaatgccgcgatcacccccagcacgccaccgatcaaggtgccgacgataccgatcaccgtaccctggaccatgaagatcgccatgatctgccgtggcgtggcgccgatggtgcgcaggatcgcgatgtccgcgcccttgtcgttcaccaccatgatcagcgtggcgatgatgttgaacgcggccacggccacgatcatcagcagcaacaggccgatcatggtcttttccatcttcatcgcgctgaacaggctgccctgggtgtgggtccagtcgtcggccttgaagccagcacccaggctggcagcaatatcgctggaaaccttgggcgcggcgtacaggtccttgaccgccaggcgcacgctctgcacctggttcggctgccagtgctgcatctcggcggcatcggccacatggatcagacccatggagccatcgagctcggccccgaccttgaacaccccgaccacattcaaacgctgcatgcgcggggtgatgccgcccggcgcggagctgatttccggcacgatcagggtcagcttgtcgccgacattcaggtggaagcgccgtgccgtgatctcaccgatcaccaccccgaactcgcccggtttcaaggcatccaggcggccctggacgatgtgctgggcaacgatggagaccttgccttcctgggccgggtcgatgccgctgatctggatcggctgcatcgagcccttgtaggagagcatgccttccatctcggtaaacggcaccgcggccgtcacctcgggatttttcatcgccgcggcggccaccggctgccagtcgtcgatcggcttggcgccgacgatggtggcgtgaggcaccatgccgaggatgcgcgagctcatttcgcgctggaaaccgttcatcaccgacagcaccacgatcatcgccagcacgcccagggcgaggccgatcatcgaggtcatggagatgaaggaaacaaagcgattgcggcgcttggcgcgggtatagcgcgtgccgataaagatcgataacggtctgaacattcgctggggcaccgtatggaaattaaagacccggcgcctgtttcaggcgccgggttgcgaccaatcagatgggcgtcaggaaaccttcctgcaggtgcaggacgcggtccatctggcgagccaggttcatgtcgtgggtcaccaccaggaacgcggtacgcatcgaggtgctgagttccagcatcaagtcctggatgccctgggcggtgtgggagtcgaggttgccggtcggctcgtcgagcatcaccagccctggtttgttgaccagggcacgggcgatggccacgcgctggcgttcaccaccggacagttcggccggcttgtgctccaggcgatgggccagccctacccgctccagcaaggccgtggcccgctgacgtgcttccgggatcgcggtcttgccgatcagcagcggcatgcagacgttttccagggcggtgaattccggcagcaagtggtggaactggtagacgaagccaagggcgcggttacgcagcaggccgcggcccttctcgctcagcgccgaaagctcctcgccgtcgagccagacgctgcccttggtcggcgtgtcgaggccgcccagcaggttgagcaaagtactcttgcctgaacctgaggtaccgacgatcgccacgcgctcgcccgggtgcaactccagttgcaggccggacaacaccaccaccgattcaggaccttcctcgtaggacttgcccaggtcgcggcagctcagaattgctttttcactcatgcccaactcactcataacgtagcgcctccgccggctgggtgcgcgcggcacgccaggctggatacagggtggcgaggaaactcaggaccagtgccgcgccgcagaccatcaacacatcctcggccatcagttgcgatggcaggtagtcgatgaagtacacgtcggcattgaggaatttgtgcccgatcaggccttcgagggcggagatcgtcgcgctcacgttcaacgccgcgaacatcccgaccacggcgccgatcaaggtaccgatcacgccgatcaccgtgccctggaccatgaaggtcgccatgatgctggccggcgtcgcgcccagggtacggaggatcgcgatatcgcccttcttgtcgttcaccaccatcaccaaggtggaaatgatgttgaaggcggccacggcgacgatcagcagcaacagcaggccgatcatggctttttccatgcggatggcctggtacaggttgccgtgggtacgggtccagtcacgggcgtagtactggttctcgcccagttgctcggcgatttcccaggcggtgcgtggcgcctggaacagatcgtcgaacttcaggcgcaggccctgcacctgatccggcttccagcgatgcagacggcccaggtcgtcgaggttggtcaggcccagatagccgtccagctcgccggcgccgacatgaaagatgccgaccacggtaaagcgcttcatgcgcgggaacatcccggccggggtcaccgtgacctcgggggcgacgaaggtcagcttgtcgcccaggccaacccccagcttggtcgccgccttgtcgccgatcacgatgccgaagctgccgggggccaggtcgtccagcttgccctgcttcatgaagttatcgatgatcgaaacctggcgttccttggccggatcgatggcgttgagcaggactttctgcacctggccgttattggtcagcaacccctgcatctgggtgaacggcgcaaccgccagcaccttggggttctgcttgaccttgtcggccaggccttgccagtcgctgatcggctcaccggattcgatggtcgcgtggggcaccatgcccagcacgcgggtgcgcatctcatggtcgaagccattcatcaccgacagcacgacgatcatcacgaccacgcccagggcgagcccgatcatcgaggtcagggaaatgaatgacacgaaatgattgcggcgctttgcacgggtataacgcgtgccaataaatacgaagagaggtctgaacatgtcggggcttgttcggaggaaaagaagacgtccttgtggcgggtcctggtaagcagctttacactcagaccaccgccgctaccatgggttcgccatgtcgacattagatgaagaagatcgccgcgaatactaccgtatcgaggacacgatcgcactggaaattagccccttgtccgcccacgaagcggcgagcaaggaagtgttgcaggatgcgtcgccgctgttcaacctgctcagcgagctgcatctgagcgaattcgaatcgcagcacctgctgcgccaggtcagcgaacgcgaccggaccctggccaactacctcaagtccatgaacaagcgcatcgacctgctcagccaggtggtggcgcagactgtactcggcaagttcggtgagccgcagcgggtgattctctccgagggcggcatcgagttcgaacatcacctgtcctacccggccggcacccacctggcggtcaagctgctgctgatgccccaggccttgggcctgttactgcgggccaaggtcacccattgcgaaacccgcagtttcggcacgttcgaaatcggtaccgagttcgaatcattgaccgacgcccaacgccagttgctggcgcgctatatcctgcagaagcaagcccaggaacgtcgccaggcccgagagcagaacgacccggcagccgattgacctgcggccccaccgcgcagcactgaccatctaatggaaaaatttccgtgaaggagcaatcgtgaccctgatttatggccaccgcggcgctaaaggcgaagcaccggaaaacaccctgaccagcttccagcagtgcctcaagcatggcgtgcgccgctgcgaactggacctgcacctgtccatggacggcgagctgatggtgatccacgacccgaccctcaagcgcaccaccgaccgccgcggcaaggtggtcgagcacagcgccgaagaactggtgtcctatgacgctcgcaagggcggcccgggctgggtcacgccctgcccgatcccgcgcctggaagaactgttcgaaaaatgcgacttcgagcactggcagctggaggtcaagagcgcctcgcgcacccgtgccgccaccacggtgctggcgattcgcgagatggcgcagcgtttcggcttgctggacaaggtcaccgtcacctccagctcacgggaagtgctcaaggcggctgtcgagctgaccccggacctgtcgcgcgggctggtcgccgaatacgcctggctcgacccgttgaaggtcgcgcaaagctacggctgcgagattctggcgttgaactggacactctgcaccccggagcggctgcaacgggcgcagcgccagggcttgcatgtgtcggtatggacagtcaacgagcctgcgctgatgcgcaggctcgccgacttcggcgtagacagcctgattacagactttcccggtttggccagcgccacgctcgagagttactgaaatcggtctccccggccggctcaggccaccggccggagtcgctcaaaaaagccggttgaggccgtcgtaagcggctacccgataggcttcggccatggtcgggtagttgaacgtggtgttgacgaagtacttcagggtattgagttcgcccggctggttcatgatcgcctggccgatgtgcacgatctccgaagcctggtagccgaagcagtgcacgcccaggacttccagggtttcgcggtggaacaggatcttcagcatgccttgcggctcaccggcgatctgcgcgcgggccatgctcttgaagaaagccttgcccacttcgtacggcaccttggcctgggtcagctcctgctcgttcttgccgatcgaactgatctccggaatggtgtagatcccggtcggcacgtcgttgacgaagcgccagctgccattgtcgacgatgctgccggcggccgaacgcccctggtcatgggcggcactggccaggctcggccagccgatcacgtcgccggcgccgtagatgttcggcacgcaggtgcggtagttctcgtccacttcgatctggccacggctgttgaccttgaccccgatgttttccatgcccagccggtcggtattgccagtccggccattgcaccagagcaaggcgtcggccttgatcttcttgcccgacttgaggtgcaggatcacgccattgtcgagaccttcgacgcggtcgtactcctcgttgtggcgcacggtgatgttgttgttgctgaagtggtagctcagcgcctgggagatctcggaatccaggaagctcagcaactggccgcggttgtccaccagctcgaccagtacccccaggccactgaagatcgaggcgtattcacaaccgattacgccagcgccgtaaacgatgagtttgcgcggggtgtggccgaggctgaggatggtgtcgctatcgtagatacgcgggtggtggaaatcgatatcggccggacgatatggacgcgagccggtggcgatgatgatgtgcttggccaccagcttctcgaccacgccgttggcgcagaccacttcgatggtctgctcgtcggcgaagctgccggtgccgaagaacacgtcgacccggttacgcgcgtagtagccagtgcgcgaggcgacctgcttggagatgactttctcggcgcttttcagtacgtcggggaacgagaaccagcgcggctcgccaatggcccggaacatcgggttggtgttgaactgcatgatctgccggaccgagtgacgcaaggccttggacgggatggtgcccaggtgggtgcagttaccgccgacctggcgacggctatcgaccatcgctaccttgcgccctgctttcgcggcgttcatcgccgcaccttctccagcggggcctgaacccagcaccactacgtcgtagttgtagacagccatgcgtactcctcagaacaggccgcggtacccgcgtggcacctgcggctaaatcatgccgcggccagcggcatgaaggatcaatttggctcggttacgaacccgggcacagtctatagaagcgtcaacgccgcgcacattaacccttggtcgcgtcgccggctacttttgcctgcgacatcgcgccgcggcaccgcgcaagattactgcttttgtccggccaacaggcgatcaaacgcgcggttgctgcgtgtgacgaagcctgtatcggcgcggatcacaaaaaatgcggcgatatcgtgtttttccgcgtaatcccaaccgcgctcggggccgaggatcagcagcagggtcgacagaccatcggccatcacggccgcgggatgaatcaccgtgaccgaagccagcccatgctcgacaggcctgccggtgcgggcgtcgaaggcgtgggaataacgctgtccgtcgcgctggaaataattgcggtagtcgccggaagtcgagaccccataaccatcgacggcgatgacccgctcggccagctgtcgatcgtcccgcggctcctccagggcaatgcgccacgccgaaccatcgggtttcctgccgacggccttgagttcgccggtggcttcgaccaggtaactgtcgatgcccatttccgcgagcctggcggcaatccggtccaccgcatgaccggcggcgatgctgttgaaatccacctcgaccgcggcgtccttgcacagctggtcgccctcgatacgcagatgggtatagccgactcgctgccgcacctgcgccagcgccgtatcgctcggcaccgcctcaccgcgcccctgcggaccgaagccccagaggttgagcaacggctcgaccgtcagatcgaaggcgccctggctgtcccgcgacagctgctggccaatctcgatcaagcgcaggaccgccgccggcatcgcctggcagctattggccggcagatcgttgaagcgttcgatgtccgagtcgctgcgataggtcgacatctgccggtcgatctgcgcaagtatccgctcgacctgggcctgcacctcactcggcgcagccaggcctgcccgcctcacgtacttgatcgagtaggtgctgcccatggtcgggccgccaaagctttccagcgaatcgccccgatcacatccagccagggccatgaccaaaacgacaggaagccaccctcgcacccaagatccacccagcaagacttcgcctcccgacactcgatttccctctcggcagtcgccgatcagggccggccattatgcggcagccaccgcggatttgatgcaggccgaacccagctcatcgcgagcttgctcctgcgggtttattccgcgaactggcgggcaataaatcccaagccgtccatctacttagcaagcaagctaagagtttttgttgcctcgacggactcatacacatattgttacaaactgtctggcttgcggcttagccgccccagaccgtgcagccaggacagataacgaccagggatcgctaacaaaatagccaaagtgagtgaataaaatgtccacgaccacgggcaaaggcaaggcgatctttcgcgttgtcagcggcaactttctggagatgttcgacttcatggtctacggcttttacgccacggccattgccaagaccttcttccctgccgacagtgctttcgcgtcattgatgctgtcgctggcgaccttcggcgccggcttcctgatgcgcccgctgggcgcgatctttcttggcgcttatatcgaccgtcatggccggcgccggggcctgatcatcaccctgctgctcatggccgcgggcaccgtgttgatcgcctgcgtcccgggttatgccaccctcggcgtcgccgcgccgttgctggtgctgctcggccgcttgctgcagggcttctctgccggggtggaactgggtggcgtctcggtttacctcgcggaaatctccaccccgggccgcaagggcttcttcgtcagctggcaatcggcgagtcaacaggccgccgtggtcttcgccggcctgctgggcgttggcctgaaccattggctgagcccggaacaaatgggcgactggggctggcgcatgccgttcctggtgggctgcatgatagtgccggcgatcttcatgatccgtcgttcgctggaagaaaccccggagttccaggcacgcaagcaccgccctaccctgcaggaaatcatccgttccatcggccagaacttcggtatcgtcctggccggcatggcactggtggtgatgaccactgtgtccttctacctgatcaccgcctacaccccgaccttcggcaaggccgaattgcagctgtcggacctggacgctctgctggtcaccgtgtgcatcggcctgtcgaacttcttctggctgccggtgatgggcgccgtctcggacaaagtcgggcgcaagccgctgctgctggcggcgaccgtcctggcgatcctcacggcttacccggcactgtcctggctggtggccaacccgagtttcagccacctgctgatcgtcgagctgtggctgtccttcctctatggctcatacaacggcgccatggtggtggctctcaccgagatcatgccggttgaagtgcgcaccaccggcttctccctggcctacagcctggccactgccacctttggcggcttcacgccggcggcctgcacctacctgatccatgcgctggacaacaaggcggcgccggggatctggctcagcggcgcggcggtgctgggcctgatcgcgaccctggtgctgttccgcggcaacaagcatgaactgcgcactgcgcaggcagcagtagtgggtggcgcctgatcgaccgtcttcgcgggcaatcaactcagccgtcaaacgccacaaacaaaaacgccccgacaagtcggggcgttttcatgtgcggctaaggcttagcgcgggaacgcaggcgggttcacaccggccatgtcttccatcacgcgaaccacctggcagctgtaaccgaattcgttgtcgtaccagacgtacagaacaacgcggttatcctgggtgatggtcgcttcagcgtccactacaccggcgtggcgcgagcccacgaagtcggtggaaaccacttcctgggaattgacgaagtcgatctgcttgtgcagatcggagtgcagcgccatgtagcgcaggtactcgttcatctcttcacgggtagcggctttctcaaggttcaggttgagaatggccatcgacacgtttggcgtcggaacgcggatcgcgttaccggtcagcttgccggccagctcaggcagggccttggcggcagcggtggcagcaccagtctcggtgatcaccatgttcagcgcggcgctacggccacgacgatcgcccttgtggaagttgtcgatcaggttctggtcgttggtgtacgagtgaacggtttcgacgtgaccgttgacgatgccgaacttgtcgttcacggccttgagcaccggcacgatggcgttggtggtgcaggaggcggcggaaacgatcttgtcgtcagcggtgatttcggcgtggttgataccgtgaacgatgttcttcagcttgcctttgccaggcgcggtcagaacgacgcggtcgatgcccgggcaggccaggtgctgacccaggccgtcggcgtcacgccatacaccggtgttgtccaccagcagcgcgtctttgatgccgtactgggtgtagtccacctcggtcgggttcttcgcgtagataacctggatcaggttgccgttggcggtgatggtgttgttggcttcgtcgatggtgatggtgccgttgaacgaaccgtgtaccgaatcgcgacgcagcaggctggcgcgcttggtcaggtcgttttcggcgcctttgcgcaccacgatggcgcgcagacgcaggccgtcgccaccaccggttttctcgatcaggatgcgcgccagcagacggccgatacgaccgaagccgtacaggaccacgtcggtgcctttgcggggcgaagcgttttgctggccaaccacgtcagccagctcttcgcgaacgaattgctcggcggtgcggccattgccttcgttacggaatttgaacgccaacttgcccaggtccaccgaagccgcgccgagcttgagctcgctcatggccttgagcagtgggaatgtttcgtggacggagagttcgctatcgtcggaagagcgatggcgagcaaagcggtgagctttgagaatcgcgatgacagactggttgatcaggctgcggccatagatcgaactcaccacattgttattgcggtagagctgaccgataagcggaatcatcgcttctgcgagcgcttcacggtcgatccattcaccaagacactggtcgggcttctgagtcacgggaaccttccacatgtaggggctgaaaaaaggggctacattatgcagccgagtcccctgcgtagcaatgcgcgcctgtcgcgcggaacgtaacaaaaacccatccggaaaaaacacaccccgctccagcccagtaaatacgcggcttccagaaaggcctcattttgcgcggtatcccagcgttgtctgtaaccctccgtaacaccgccccgattcggcactacatttcccgccaaaaaacgcgtttttttgtcataaccactacattttccgcaaccgcgtaatagacacatcagcaactgacagccggtacgccggaccgctacaattaccgactttgtcgcaacgctggagctcaaccttccgtgcccgttctgcgtctaccgcaactccctgccgccgccggcaaacagcactggggcaatctgcccggtgccgccctcagcctcgccattgccgaggctgccagcgccgccaagcgcttcaccctgctgctgaccgccgacagccaaagtgccgaacggctggagcaggagctgagtttcttcgccccggatttgcccgtgctgcatttcccggactgggaaaccctgccctacgacctgttctcgccacaccaggacatcatctcccagcgaatcgccagcctgtaccggctgccggagctggagcatggcgtgctggtggtgccgatcaccacggccctgcatcgcctggcgccgaccaagttcctgctgggcagcagcctggtgctggacatcggccagaagctggacgtcgaacagatgcgcactcgcctggaagccagcggctatcgctgtgtcgacacggtctacgagcacggcgaattcgcggtgcgcggcgccttgatcgacctgttcccgatgggcagcaaactgccttatcgcatcgacctgttcgacgatgaaatcgagaccctgcgcaccttcgatccggaaaaccagcgctccatcgacaaggtcgattcggtgcgcctgctgccggcgaaagaattcccgctgcagaaagaagccgtcacccgcttcaaggcccgtttccgcgagcgcttcgacgtcgatttccgccgctgcccgatcttccaggacctgagcagcgggatcaccccggccggcatcgagtattacctgccgctgttcttcgaagacacttcgaccctgttcgactatctgccccaggacacccaggtgttttccctgccgggcatcgagcaggcggccgagaatttctggaacgacgtgcgcaaccgttacgaagaacgccgcgtcgatccatcccgtcctttattgccgcctgccgagttgttcctgccggtggaagactgcttcgcccgcctgaaaagctggccgcgggtggtcgccagccagcaggacatcgaggccggtggcggccgcgagcgcttcccggcgcagcccctgcccaacctcgccattgaagccaaggccaatcagccgctggcggccctggccaatttcctcgatgaattctctggacgcgtactgttcaccgccgaatccgccgggcgccgcgaggtgttgctggaattgctggaacgcctgaagctgcggccgaagaccgtcgacagctggccggacttcgtcgcgggcaaggatcgcctggcgatcaccatcgcaccgctggacgaaggcttgctgctggacgatccggccctggcgctggtggccgaaagcccgctgttcggccagcgcgtgatgcagcgccggcgccgggaaaaacgcgccgacgccaacaacgatgcggtgatcaagaacctcaccgagctgcgcgaaggcgcgccggtggtgcatatcgatcacggcgtgggccgctacctgggcctggccaccctggaaatcgacaaccaggccgcggaattcctcaccctcgaatacgccgagggcgccaagctctatgtgccggtggccaacctgcacctgatcgcccgctacaccggtagcgacgatgccctggcgccgctgcaccgcctgggttcggaaacctggcagaaagccaagcgcaaggccgccgaacaggtgcgcgatgtcgccgccgaactgctggacatctacgcccgccgcgcggcccgcgaaggctatgcctttgccgatccgaaagccgactacgccaccttcagcgccggcttcccgttcgaagaaacccccgaccagcaaaccaccatcgaggcggtgcgcgaggacatgctcgcggccaagccgatggaccgcctggtctgcggcgacgtcggcttcggcaagaccgaagtggcgatgcgcgccgccttcatcgccgtgcatggcggcaagcaagtggcgatcctggtgcccaccaccctgctcgcccagcagcactacaacagcttccgcgaccgcttcgccgactggccggtgaccgtggaagtgatgagccgcttcaagtccgccaaggaagtgaatgccgcggtggccgacctggccgaaggcaagatcgacatcgtcatcggcacccacaagctgttgcaggacgatgtgaagatcaagaacctcgggctggtgatcatcgacgaagaacaccgcttcggcgtgcgccagaaagaacagctcaaggccctgcgcagcgaggtcgacatcctgaccctgaccgccacgccgattccgcgcacgctgaacatggcggtgtcgggcatgcgcgacctgtcgatcatcgccacgccaccggcccgacgcctgtcggtgcgcaccttcgtcatggagcagaacaagagcacggtcaaagaggccctgctgcgcgagctgctgcgtggcggccaggtctactacctgcacaacgacgtgaagaccatcgagaaatgcgccgccgacctcgccgaactggtgccggaagcgcgcatcggcatcggccacgggcagatgcgcgaacgcgaactcgaacaggtgatgagcgacttctaccacaagcgcttcaacgtactgatcgcctcgaccatcatcgagaccggcatcgacgtgccgagtgccaacaccatcatcatcgagcgcgccgacaagttcggcctggcccagctgcaccagttgcgcggccgggtcggtcgcagtcaccaccaggcctatgcctacctgctgacgccaccgcgccagcagatcaccccggacgcggaaaagcgcctggaggcgatcgccaacacccaggacctcggcgccggcttcgtgctcgccaccaacgacctggagatccgcggtgccggcgaactgctgggggatggccaaagcggccagatccaggcggtgggcttcaccctttatatggaaatgctcgagcgcgcggtgaaagccatccgcaagggcgagcagccgaacctcgaccagccgctgggtggcggtccggaaatcaacctgcgcctgccggcgctgattcccgaagactacctgccggatgtgcatgcgcggctgatcctgtacaagcgcatcgcctcggccaccgacgaggacggcctgaaggacctgcaagtggagatgatcgaccgcttcggcctgttgccggaaccgaccaagaacctggtacgcctgaccctgctgaaactgcaggccgagcaactgggcatcaagaaggtcgacggcggcccgcagggcggtcgtctcgagttcgccgccgataccccggtggacccgctggcgctgatcaaactcatccagggccaacccaatcgctacaaatttgaaggcgccacgctgttcaaattcatggtgccgatggaacgtccggaagaacgcttcaacacattggaggcgctgttcgagcgcctcaccccgaaaactgcttgaaggacgccccatgcgcctgtttcgctcactgaccttgctcctgaccctggtcgctccctcggcgtttgccgacatgtatcaggtcgaaatgattctggtccggcagaacgcggttcccgccatcgtcagccgcgccgcccccgaagactgggccgccggcgcccaacgcctgggcgccgacagccagcgcaccccggcgctgggtggcgtggtcgagaaactcaccgccagcggcgactacagcgtgctgatgcacaaggcctggcaacaggcgctgggcgaaaacccggtgaaagtcgcggtcagcgagggccaggaacagttcggccagttcccgatcgagggcaccctgaccctcaagctcgggcgcttcaccgatgtggatgcgcagttctgggtcaaccggatcgacagcaacggcctggtgaccgccagcgaacgcctgaaacaggaaagccacaccaagaacggccagctcaactacctcgacaacggtcacctggccctgctgatcaagatcacctcgctgtcggcccccgcgccgcgcgaggcgccgcctgaaatcgtggactgacagaagtccctatgcccccgaccctgaccaaacccctggcaccttcctgggtcagccgattcaaggaacaggccctggagcgtggccgccgctacgccctggagaaccgcgtcaggatcgtccaggccggcgacagcgtcatcaccgccagttgcgaaggttcggggggcaacgtctatcgacagaccatcagcctgcgcgagtcggccaggaacaccttgctgatggtcgaagcctcctgcacctgcccggtgcgcagcaattgcaaacacattgccgcggtgctgctgaaaatcgaggagaccctggcctatccggcggcggcgaaagacgccgagctgctggagaaactccaggccgtcctggaaaaccgtagccccgccccgctgccgcaacagatcgtcgacaacgtgcagccagtgccccggctgtggctggccagtatcgagttcagcgccttcgaaccgcgcaacggcaagatgcagcgctacatccagcaccgtgccgcgctgtcgttcagctacctggaggaatacgtcagcggccagaaaaacgccgacgtggtgattcgccaggaacaccagaccctgcgcatcaagcgtcagccggaagtcgaacagcgctatcgcgaacagctgcgggcgctgggtttcaagatcgccacccggcaaagcaaagccctgccggaaagcgccggcgagctgtatgaaatggtcaacgacagcgcctggctgaccttcaccctcaacgaactgcccaagctgcgcacccagggctgggagctgcagatcgacgacgacttcggcttcgacctgaccgccgtggacgactggtacgccacggtggacgaagcgccagggcgcgactggttcgacctggagctgggcatcatcgtcaacggcgagcgcctgagcctgctgccgatcctgctcaacctgatgcgctcccacaccgagatcctcaacccggaacgcctggccagacgccgggacgacgagctgatcctggtgaacattcccgggcgccccaactcgcccaacggccccctgcaagtggcgctgccctatggccggctgaagccggtgctggccaccctgggcgagttctacctgcaggaacccggcgaaaccacactgcgcctgagcagtgccgacgcgacccgcctcaatccgctggaagacttgcccctgctctgggaaggcggcgaacacatccgctccttcgcccagcggctacgcgacatcaaggactactcggccctcgcgccagagggcctgaacgccacgctgcgcccctatcagctcgaaggcctgagctggatgcagtccctgcgccagctggaagtcggcggcatcctggccgacgacatgggcctgggtaaaaccctgcagaccctggcccatgtgctcagcgaaaagaacgccgggcgcctggaccgaccgtgcatggtggtgatgcccaccagcctgatccccaactggctcgacgaggcggcgcacttcacgccgcaactcaaggtcctggccctgtatggcgccggccgccataagcacttcgcccggctgagcgactacgacctgatcctgaccacctacgcgctactgcccaaggatgtcgagcaacttgccgccctgcccctgcatgtcctggtgctggatgaggcgcaatacatcaagaacccgtcgagcaaggcggcccaggccgcgcgcgcgctcaatgcccggcagcgcctgtgcctgagcggcacgccactggagaatcacctgggcgagctgtggtcgctgttccatttcctgctgcccggctggctgggggacgtgaagagcttcaatcgcgactaccgcgtgccgatcgaaaggcatgccagcgaagtgcgcctgcagcacctcaatgggcggatcaagcccttcctgttgcgccgcaccaaggaacaggtggccaccgaactgccgcccaagaccgagatcatccattgggtggagctcaatgaagcccagcgcgatgtgtacgaaaccatgcgcctggccatggacaagaaagtccgcgacgaaatcacccgcaagggcgtggcccgcagccagatcatcattcttgaagcgttgctgaaactgcgccaggtgtgctgcgacctgcgcctggtcaacgaagacgcgatgccggtgcgaggcagctcctccggcaagctcgacagcctgatggagatgctcgaggaactgttcgacgagggtcggcgcatcctgctgttctcgcaattcacctcgatgctgagcctgatcgaggccgagctgaaacggcgcaacgtcgcctacgccctgctgaccggacagactcgcgatcgccgcacgccggtcagggacttccagggcggaaagctgcagatcttcctgatcagcctgaaagccggcggcgtcggcctcaacctgaccgaagccgacaccgtgatccactacgacccctggtggaacccggccacggaaaaccaggccaccgaccgcgcctatcggattggccaggagaagccggtgttcgtctacaagctgattgcccgcggcacggtggaagagaaaatccagcacctgcagcaggagaaatccgacctggccgcgggcgtgctggatgggcgcaaggccggggactggaagctgcagagcgaagacatcgaagccctcttcgccccgctgcccgacaagaaaggcggacgctgatctggagccgctggcgcgcctgcgatcggctgcgcaacagacgtaaagcctcatgatgtttcagtaatatcgcgggctcaggttttgcgagcgctacgcgctcgatcgcagcctgcggcagcggctacaggtttgccgcgagcactcgcgccagcgtcgcctgcaccttgcccatgccgtcctgcaacgcctgctcgatctcggccatggtaatcaccgcagcggacttgcccgccgccgggttcaccaccagcgccaggcaggcgtagtccagctccagctcccgggccagcgccgcttccggcatgccggtcataccgacgatgtcgcagccgtcacgttccaggcgggcgatctccgccacggtttccaggcgcgggccctgggtgcaggcgtacacgccctgactgctgaattcgcagccttcggcggccagcgcggcaatcaattgctggcgcagcgactcgctgtagggatagctgaagtcgatgtgggtgacctgctccaggtcgtcggcaaaataggtgtgctcacgaccgctggtgtagtcgatcagctgatgcggcacgcagaaatgcccggagcccatcgccggatgaatgccacccaccgcgttgaccgccagaatcgcctcggcgccagcctgcttcagcgcccagagattggcccgatagttcacctgatgcggcgggaagcgatgcggatgaccgtgacgcgccagaaacagcacctcgcgaccggcgtattcacccttctggatatccgccgacggagcgccatagggcgtgtccaggggcaaggattggtgaatgctcaagccttcgagccgggtcaggccggtaccgccgataatcgcgtagaccgtcatcgcaaaagcccttaatcgatcagttgggcatctttgagtgcgccgagcgccgtcagccaacgcggatcctgacgatagtcggtgcaggcaaacgcctggccacgcatccgcgcaatacgcgccgacggcgtcactttcagacgctgggccgcgctcagggccagctcggccgctgcccggtcgttgcacaccaggcccatatcgcaaccggccgacagcgccgcttcgatccggctcgcggcatcgcccaccacatgagcaccggccatcgacaggtcgtcactgaagatgacaccgtcgaactgcaattcaccgcgcaggatctcctgcaaccaacgacgggagaacccggctggctgggcatcgacctgagggtagatgacgtgggccggcatcaccgccgccagctgcttgctcaggcgcgcgaaaggcaccaggtccttggcgcgaatctcgtcgaggctgcgctcgtcattggggatcgccacgtgggagtccgcctcggcccagccgtgcccggggaaatgcttgcccgtggccgccatgccggcgctgttcatgccacggataaaggcgcctgccagcaaggcggcgcgctcggggtcgccctcgaaggaacgggtgcccaccacggcgctgcgctgatgatcgaggtccagcaccggcgcgaagctcaagtccaggccgacggccagcacttcggtggccatgatccagccgcactgctcggccaggtactcggcattcggattgtcggcgatggcacgcatggccggcagccgcacgaagccctggcgcaggcgttgcacgcgaccgccctcctggtccaccgccagcagcaggtccgggcgaatcgcccggatggacgcgctcagctcacgcacctgccgcggatgctcgatattgcgggcaaagatgatcagcccacccacttcgggctggcgcaggagttggcgatcttcagccgtcagccaggtaccggcgacatccaccatcaaggagccttgcaggcctgtggtcatagcaattccttagtaacgaagtgcgcgcacggcatcgcagaaagtgctggcgtggcgcggacgcacgagtccattgccggcggcaaggcccggcaagcgacgatcggcgaaaggtgtgaagagaggtaagaaacgagagtcgacatgggcggctagcttagcggatgtaagctgccgcgcccacccggacggtcaggccttggcgaccgccggagtcgatttgctgcgcggcttgagctgcgccgtggccatggcatcgtcggtgacgccggtttcggcgcgcatgccggccgcaaggaatggcaccatcaggcgcattacctgctcgatcgaggtattgaccccaaagtcggtctcggcaatcgcacgcaaggccttgatccccgacatgctgaaagccgccgctcccagcatgaagtgcacacgccagaacagttcgatcggcgggatgcgcggcgcggcttcgttgaccagcagcatgtagcggcggaacaccttgccgtacatgtcttccaggtaacgccgcaggtgcccctggctctggctgaaggccaggcccagaaggcgcatgaaaatggacaggtcgttgccgctgcgaggctggaccaccaaggcctgctcgacgaggatttccagcagctcttcgaggcttggcttactgtccggcttggccgaacgccgctccagctcacggtcgaggctgatgcagaacggcccgaggaagcgcgagaacaccgcctggatcagggcctttttggaaccgaaatgataattcaccgccgccaggttgaccccggccttgctggtgatcagccgcaatgaggtttcggcaaaacctttttccgcgaacaactgctcggcagcatcgagaatgcgttcaacggtttccgactgggccatggctactccgcctgacaaacacttgtttgaaacatacgtttcagccccagccttgtcaagcctgcctgtccgttttgcggccggtcagtcagctatttaatcatacctgccgcttcctgtagccagccacgcgacaccaggcatgcgcagcggcgacccgaccgtccagcggcgattggaaaaaggaggattgccaagcggcattcactgtatataattccagtcactgtataaaaagacagagcgatcgacatgctaaaactgacgccacgccaagctgagattctggcttttatcaaacgctgcctcgaagacaacggctacccaccgacccgcgcggaaatcgcccaggaactgggcttcaagtcgcccaacgccgccgaagaacacctcaaggcgctggcccgcaagggcgcaatcgaaatgactccaggcgcctcccgcggcattcgcatcccggggttcgaggccaagcccgacgactccagcctgcccatcatcggccgggttgccgccggtgctccgattctcgccgaacagcacatcgaagagtcctgcaacatcaatccggccttcttccatcctcgtgcggactacctgctgcgggttcacggcatgagcatgaaggacatcggcattttcgatggcgacctgctggccgtgcataccactcgcgaggcccgcaacggccaggtcgtcgtcgcccgcattggcgacgaagtcaccgtgaaacgcttcaagcgcgaaggcagcaaagtctggctgattgccgaaaaccctgagttcgcccctatcgaagtcaacctgaaagatcaggacctggtgatcgaaggcttgagtgtcggcgtcattcgccgctaaaggaggctgtatgcagttccctcacacaccacagcatgcacaactgccactgttcgaagcgttcatggcccaacccctggcgcctatcctcaaagaggtcgtcgaatcgccctggagcaacgaaccggaagccttcagtgaactgtcgttacgcggtgccgccgggaactgcctgagcctgctggcgcccatcctcagggaattgagccaggaccaggatgcgcgctggctgacattgattgccccaccggccagcctgacccaggcctggctgcgggatgccggcctgaaccgcgaacggattctgctgctgcacccgcgcggcgcccaaagcgcgcaacagctggcttgcgaggctctgcgcctgggacgcagccacaccgttgtcagctggctcaacccgttgaacagcagcgcccgtcaacagctcatcagcgcagcccgcacgggcgacgcacaaagcctgaatattcgtctgggctgaccgctagaagcgtcgatggacacgcttgaatgacacaaggcttctccaggattgagaagccgaaaggaggcgacgaacgacagcaaaaaaaccgacaaacggactcagtgaagaatccgtggcccctcttctttctccaattcgccttcaaccaggcgacccgccatctgcacaccgacgctcaacatggccttggccacctcgacatgctggccttgcaaaaaggctttggcatcttctgaaaagtccagagtgaccagagaaccctcgtcctcggccctgcgcagctcaatacgaccgtctggcaattcgacaatttctagaaaggacgttggcataaaggtctgttctccacgaaaggccgggattatatcagtcatcaccccgacctcgcgcgggcccaaacggttttctttattggcctgacgttacaaacaggcatttgccgtcagaaattcggcttgtaatcaaaactcgcggcggcttccttatcggaaaacggcgtaatagcctgcttcttgttgatgaccgtgttgaccatcgaactggggaacatctggatgcagttattgaactcctctacggtccggttgaagaccgtaacggcggctgcaatgttcgcctgctgttcgacgatttccttcatcaacccactgacgattcccgccgccttgagttccggataggcctcaaaggccatgttcagcccccccaccagttccctagtggccatctgcgtcgacttcagagcctcaccactggccgcctcaggcaaccttccgagggccgaacgcaggcccaccactttttccagcacgttgctttcatagatcttgaaactggaagcctgctcctccagggcatccagcaccttgatcttctgccgctcatacacgagcacatcggcccatgcgcgctgagcgcggttccctgcgccgacaatcttgttgtagtaataccagaggagccaggccaccagtatcgctgtaagaaggatgatcatttactgctccatatcctgcgttcttttcttcggtagattgaaattgtcgtcatgcaactcggcaagctggtgcaacagctccagcaccggcctcaggcgcggcatcgtcgccccctgcatcaagccggcatgaaaggcgaccggctccgcaaggcttaccgccgaggtagcgatgccgaccacatcatcattgttgaagttcacgcataggcggctctgggaggagaactcgaaactgacgtctttcagctccttggcgatctgcagcaacttgagcacggtgaccggtgtggcgaaagtcgcgcaggccatctccgtcgcgccagtcagggtgaaggcagaattgaattcccgagtcgtggtcttgtagagatgctcgcggtccatggctcgatgcttgtcaccacgaacggcaacctcggccgtccagggaaagtcgaacaccaggctatagcggtcatacccaacatagcgggttctggtttcccttcgagaaccgcccttgccatcggaaaccgatacttcgtaggtttccatatcgacgtaatgcagatggtggaaagcgtaaggcagatcgtgcaccgcaccgttataaacgcccaccagcgtgttcttgagctcacgggaatagttaccccgacgaaagtgcgcaaactcattcatcatcacggccagggtgaaaattcccgaagccgatgcatcacctacgccagcgctgagcagagccgctttgcgaatgatcttctgcgatagcgccttcaccacatccggatgaatgaagtgattggcgccgcgtcggcgcatcaggtagatcccgggaatcagcaacggccagaccagtattccgacaatgcacaggcaccaggccagtttttttgaattgggatctgaacgactaaggacaataggttcgggaaaatcgcgaatctgctccaccgccttgagcaaatcccgggacgaagcggccgcgtccgccagacgatcgacacgatcgaacagcgcaggcagcgcattcgtctctgtagctgaagccattactcatccttgaatgattggtcgtactcgaagatatccgctagcggcggctcaacactcattcaggccgtcacggaagcgaatcgccaaagccttgaggttctgacgccattgctccagctcttcccggctcagctgcggtgcctgctcttcttcatcgaggttcactgcgacaatcaacggctgagtgacatcgcccttgggtttatgcggcacccgcggtggctggaacatcgccgaatgggcggccagcagcttcgccagccaggtctccgggttatgggcaagttccaccagctcggccagctcggggatggcgatgctttccagcacctcacgggtgagcagcagctccgcgcggggcgcattggcctgcgggaggcgatagaagccagcaatttcatggcacaagccaagcagcgcaccgtacagatgaaacaacaccgactctcgtcccgcctgcaccagcgcctgagcattcattgccccgcccgcctcggctcgcgccaaggcttccagcgacaggccggcgaaataaattttctggttggtacgggtatagagttcgtgggccatgacggcaatctccacaacgaatagataacagcaggctggccgtacagtgtcgtggaacactccagcccaccgcaagcccaaaagaaaggccgcgtacccttgagaggtttacgcggccttttcagaagcgtccgatgcgaccttaacgcttgtcttcgaccttccagctaccgccgtcgtagaacgcacgccagccggtcggcttgccgtcgacttcggtctgcacgtactgctccttggtcttgcggctgtagcggatcaccgccgggcgaccgtccgggtccttcttcggcgcttcgcagaggaagtgatacttcggatcgatctcgtctttgtgcgggatcagctcgagcaccagcggtgcgcgggtttcacggtttttcgggaactggctggccgccaggaacagacccgatgccccgtcgcgcaggatgtaggtgtcgttgaccttctcgcatttcagctcgggcatcttcaccggatccatcttcggtggtgccgcgtcaccgctcttgagcagcttgcgggtgttcttgcaggtcgggttggtgcacccgaagaacttgccgaaacggccggtcttgagctgcatctcgctgccgcacttgtcgcattccaggctcggaccttcgtagcccttgatgcggtagctgccctcttcgatctcatagcccgcgcaatccgggttgttaccgcagatgtgcagcttgcgtttctcgtccagcagataggcgtccatcgccgtgctgcagatcgggcaacggtgcttgccgcgcagtaccagcgactcggattcaccctcatcgtccgcggcgatctcatcgcccggcaccaggttgacggtagccttgcagcgttctttcggcggcaggctgtaacccgaacaaccaaggaacacccccgtggacgcggtgcgaatctgcatcgggcgaccacaggtgaggcacgggatatcggtcatcaccggctggttggcgcgcataccgctgtcgctgccttcggccacttcgagcttcttcttgaagtcaccgtagaactcgtcgaggacgtttttccagtcgcgctcgccctgggcgacgtcatcgaggtgctcttccatgccggcagtgaagccgtagtccatcaggttggagaagctctcggacagacgctcggtgacgatgtcgcccatcttttccgaatagaaacgacggttgtgcagtgccacgtagccacggtcctgaatcgtggaaatgatcgccgcgtaggtcgaaggacgaccgatgccacgtttttccatttccttgaccaggctggcttcggagtaacgcgccggcggcttggtgaagtgctggctcgggtcgagcttgatcagcttcagcacatcgccctgcgccatgtccggcaggacatcgtcgtcgcccggcttgctcatctgcggcatgacccgggtgtaaccgtcgaacttgaggatgcggcccttggcacgcagctcgaagccaccagcggcgacgctgacggtggtcgacaggtattgtgccggcagcatctggcaggctacgaactggcgccagatcagctcgtagagccgctcggcgtcacgctccatgcccgacagcttgcttggatgggtgttcacatcggacggacgaatcgcttcgtgcgcctcctgggccccttccttgctgctgtagaagttcggcgaggacggcaggtatttgttgccgaactcttcttcgatataggtccgcgccatcgtcagggcatcagccgagaggttggtcgagtcggtacgcatataggtgatgtagccggcttcatacagacgttgggccatcatcatggttttcttcaccccgaagcccaggcggttgctcgcggcctgctgcagggtggacgtaatgaagggagacgacggcttgctgctggtcggtttgtcttcgcgcttggcgatggtgtaggtcgacgccttgagcttctccagcgccgccatggcctgggcttcgttcagcggcttgaaggcctcgccgttttcccgcgccacttcgaagcgcacattggcgcccttggcggtgccgaggtcggcgtgaacttcccagtattcttcagggatgaaggcacgaatttcgcgctcgcgctccaccaccagcttcaccgccaccgactgcacacggccggcagacaggccacgggcgattttcgcccacagcagcggcgagaccatgtaacccaccacgcggtcgaggaaacgacgcgcctgctgagcgttgacccgatcgatatccagctcgcccggctgggagaaggcttcctggatcgccttcttggtgatttcgttgaacaccacgcgcttgtagcggctgtcatccccaccaatggcttcccgcaggtgccaggcaatggcctccccttcgcggtccaagtccgttgcgagatagatggtgtcggcatccttggcgagccggcgcagctcttcgatgactttttccttgcctggaaggatctcgtacttggctttccagccgtggtccggatcgactcccatgcgcgagaccagctgcttgcgcgccttctccttggccgacagcgccggtgcttcaccagcagccgccttgccacgcttggcggcaggctctttggcggcgctcgccgaaccactggtgggcaggtctcggatatggccgatactcgacttcaccacgtattggttacccaagtacttgttgatggtcttggccttagccggggattccacaatgaccagcgatttgcccatggatcggaaaattcctgaattcgagaagtgagaggcggttggcgcctgacgcggcaccgctatatatagtggcaacaaggtgaggtcaagcgcagggttctgcgcgacctcagcttaaggctgcgaaaaaagactgggttcggcctgcaccaaagcaaagcgtggcacctgctcgccgtcaacctcgaccgactccaggaacatgctcaaggggcgcacccaaaagccgtaatcgccatacagggcttgatagaacactacttcctcttccgtctcggaatgccgcgccacgctgaaaacgcggtactgcggtcccttgtaatgctgatagagcccgggttgtaattgcatgtttggccctcgtgcaaaataaaaaatataaatcttcagaaaaacaaaaaccggggcactgggccccggcttccatcaacgcaacgcttaaacgcgttcgaagacggtggcaatgccctggccaaggccaatgcacatggtggacacgccaaaggtgccgccattctgcttcatgacattgagcaaggtgccggagatacgcgcaccggaacagccgaatgggtgacccagggcgatcgcgccgccgtgcaggttaaccttctcgttcatcttgtcgagcactttcaaatctttcagcaccggcagagcctgcgccgcgaaagcttcgttgagctcgaagaagtcgatatcggcgattcccaggcccgcgcgcttcagtgctttctgcgtggccggtactggaccatagcccatgatcgccggatccacacccgccaccgccatcgagcggatcaccgccagcggctggatgcccaggtcctgggcacgctgcgccgacatcacgatcatgcacgaagcaccgtcggtgatctgcgacgaagtaccggccgtcacggtgccgcccttcggattgaaggccggcttgagggccgccaggctttccagggtggtctcgggacgaatggtttcgtcgtagtcgaacagtttcaggaaaccattctcgtcgtaaccttgcatcgggatgatttcgtccttgaacttgccttccacggtcgccttgtgggcgagctggtgggagcgcaggccgaaggcatcctgttgctcacgggtaatgccgtgcatcttgccgagcatctcggcggtcaggcccatcatgcccgaggctttcgccgcgtacagggacatgtgcgggttcgggtcgacgccgtgcatcatgctcacgtggcccatatgctcgacgccacccaccacgaagacgtcaccgttgccggtcatgatcgcctgggcggcggtgtgcagcgcgctcatcgacgagccacacagacggctgacggtctggccggccgaagtgtgcgggatctgggtcatcagcgacgccatgcgcgcaatgttccagccctgctccagggtctggttcacacagccccagatcacgtcctcgacttccgccggatcgaccttggcgttgcgttccagcaatttgctgatcaggtgcgccgacatgtcttcggcgcgggtattgcggtgcatgccgcccttggagcggcccatcggagtacgaccgaagtcgacaatcacgacgtctctaggattcaagctcatatattcactctcgctctagtagggggcgcttaaccgaagaagctctggccgttcttggccatctcgcgcagcttcgcggtcgggtggtacagcgcgcccagatcggcgtactggtcggccagggcaacgaactcggcaacaccgatcgagtcgatgtagcgcagcgcgccgccacggaatggagggaaaccaataccgtacaccaggcccatgtcggcttcggccgcggtttcgacgatgccgtcttccaggcaacgaacggtttccaggcacagcgggatcatcatccagttgacgatatcctcgtcagtgacttcacgctgctcgtacacgataggcttgagcacttccagcaccgacgggtcggccactttcttctgcttgcctttcttgtcggcctcgtaggcgtagaaacccttgccgttcttctgacccaggcgcttggcttcgtagagcacatcgatagccgaacgacggtcgtctttcatacgatccgggaaaccttcggccatcacgtcacgaccgtggtgaccggtgtcgataccgaccacgtccatcaggtacgccgggcccatcggccagccgaatttttccatgaccttgtcgatgcgcacgaagtccacgccggcgctgaccagcttggcgaaaccgccgaagtacggaaacagcacgcggttgaccaggaagcccgggcagtcgttgaccacgatcgggttcttgcccattttcttggcgtaggcaacggtggtggccacggccagctcgctggacttctcgccacgaatgacttcgaccagcggcatcatgtgcaccgggttgaagaagtgcatgccgacgaagttttccggacgcttgagggccttggccagcaggctgatggaaatggtcgaggtgttcgaagcgaggatagtgtcctccttgacctggtcttcgacttcggccagaaccgcttgcttgaccttagggttctcgacgaccgcttcgaccaccaggtcgacgtggccgaagtcaccgtaggacagcgttgggcgaatgccgttgagcacttcggccatcttcgccgcagtcatgcgccccttatcgacacggccgaccagcaacttggcggcttccgccaggccttgctcgataccgtgttcgttgatgtctttcatcaggatcggcgtgcctttggacgccgactggtaggcgataccgccacccatgatgccggcgccgagtacggcggcctgcttcacgtcctgggcgatttcgtcgtaggccttggcctttttcttcagttcctggtcattcaggaacaggccgatcaggctctgcgcagcagaggtcttggccagtttgacgaagcctgttgcctcgacttccagcgccttgtcacgaccgaagttagcggctttctggatggtcttgatggcttcgaccggcgccgggtagttcgggccagcctggccggcgacaaaacccttggcggtttcgaaggacatcatctgttcgatggcgttgagcttgagcttttccagcttcggctgacgcttggccttgtagtcgaactcgccggagatggcgcgcttgacggtggccagggccgcttcatgcagtttttccggagcgacgacagcgtcgaccgcaccgactttcagtgcgtcttcagcacggttttccttgccggcggcaatccattcgatggcgttgtcggcaccgatgatgcgtggcaggcgaacggtaccgccgaagcccgggtagatgcccagcttgacttccggcaggccgatcttggcgctggaggacatgacgcgatagtcagctgccaggcacatttccagaccgccgcccagcgcgatgccattgatcgcggcaacggtcggaacgttgaggtcttcgaaatcgctgaaaatcttgttggcttcgaggttgcctgcgacaagctctgcatccggcagcttgaagttgtcgacaaattcggtgatgtcggcgccgacgatgaagacgtccttgccactgctgacgatcacacccttgaccgacgcatctgccttgatggcgtctacggccgaacgcaattcgttcagggtaagacggttgaacttgttgacggactcacccttgaggtcgaaattcaattcgacgatgccactttcaagagccttaaccgtgatggctttaccttcgtaaatcatcaactgatctccacgatatggaagctgaacagtacacgtcggacgctaacttctgactcggcagcgacgtttccatcgatgctacgccaatccgccaggcacacccgccaacgcgatagtcgggattctggaagagccgtctggtaatacaaacgctcaattcatacgcccgtttgatttgggtacgccacattcaggcaaaatccgacaattgtcaatcgcccaaaaggttgtttaaaacgcgacttcttagtcattccagacgggcacgcaccatcaacaagccggctcatctgaggacattcatagaatcaatctttagaaaagtcgccctaatgcgtggccccataaccgattcacggctacgctggcacaaccctggagcaaaaataggggcgcctggccgaaaaccaggcgtaagatcagcgacaactctcatccccgccgctcagaaccaggggatcagaaaggatttaccggcctgcctggccaacccagcccgaccttgtcgggctttttactgcctgcctttcaataacctgtgccattgcagcgcaggtcatgcttcacgctagcgccttgagcactgcggcaatgtcttgcaaaacactggcttcgccacgttcgccccaatacaagacgatcatctgccggtcggcctcgaccttgaacacgttggccggcagcgtgcgaaagtgctcgagcaaggcaggatccgcacagacttcccgccattggttgacccacacgcccggcgcactttgccagtaggcccagcaggccggttgtgtgccgcgccgcggccgatggtattgcgcacaggggcttggaggctgcggatccatccagtgcggccactcctgaggcgccagttgcatgcccaggcccatgcggcgcgcctccatgcgcagggcgatctgcccgctctggcggcgcgacggacgcagccatgccagcgggctcaacaccaccgcgaggattgacaccactatccagaccgtcatatctgtactcccgattcttgatgagccgattgatccaggtcggaaccaatccgcttgaaaccagccatacttgaagctattgcaatcctcaggaggagcacctcatgccctaccaccatattctggtcgccgtagatctaaccgaagagtgcgatcctgttatccaccgggctcgcgagctgtcggtcagcaacagcgccaaattgtccctggtgcatatcgtcgagccgatggccatggcgttcggcggcgacgtaccgatggacctgtcccaattgcaacagcagcagttcgaccaggccaaggaacgcctcgatcgcctcatcaccaaataccctgagctgtccaaggaatacagccacctgacctatggccagccacgccaggaaatccatcatctggccaaggaacaggaatgcgacctgatcgtggtcggcagccatggccggcacggcctggcgctgctgctgggctcgaccgccaacgacgtgctgcacggcgccccttgcgacgtgctggccgtgcacctggtcaaacgctgagcccgccggcggaatgctccgcccgcaccggccctgcaaaaagcccgacatgaatgtcgggcttttttattgccgccaggtcactcaggcatccagctcggcccagcgctcgaccatcacatccagttcagcattgagctgttccagttgagcgataaccgccgtggtctcggccgcaggacgctgatagaagccagcgtcggccatttccgcttccacagcggcgatctgctgctccatggcttcgatctggccaggcaacgcctcgagctcgcgctgcaacttgtagctgagcttcttcttggccgcaggcgcttcctgtgccgcggcaggtgccgccgccacaggcgcaaccaccgccgagttcagctcggccttgcccgacttgttctcggtcacgcccagcaggcgtggcgaaccgccttggcgcaaccaatcctgataaccaccgacgtattcgcgaaccttgccttcaccttcgaacaccagggtgctggtcaccacgttatcgaggaatgcccggtcgtggctgaccatcagcacggtgccctggaaggtcagcaacacttcttccagcagctcgagggtttccacgtccaggtcgttggtcggttcgtcgagcaccagcaggttggccggtttgctgaacagcttggccagcaacaagcgagcacgctcgccaccggacagcgccttgaccggcgtgcgggcacgctgcgggctgaacaggaaatcccccaggtagctgagcacgtggcggctctggccatcgatatcgataaagtcgcgaccttcggcgacgttgtcgatcacggttttttccaggtccagctggtgacgcaactggtcgaagtaggccacgtcgatacgcgtgccctcctcgaccttgccgctgctcggcaccaggccgcccagcatcagcttgagcagcgtggtcttgccggtaccgttggcgccgagcaggccgatacggtcgccgcgctgcaggaccatggagaaattcttgaccaggaacggaccgcccggatgagcgaagctcacgtcttcgagcaccatgacctgcttgccggacttgtcggcggtttccagctgaatattggccttgccggtacgctcgcgacgctcgctgcgctcgacacgcagggccttgagggcacgcacgcggccttcgttacgggtacggcgggccttgatgccttggcgaatccagacttcttcctgggccaggcgcttgtcgaacagcgcgttggccgtctcttcagccgccagcacagcctccttgtgtaccaggaagctggcgtagtcgccgttccagtcgatcagcccaccacggtccagctcgagaatccgggtcgccaggttctgcaggaaggaacggtcgtgggtaataaagaggacggcgccctggaagtccttcagggcttcttccagccaggcgatggcgccgatatccaggtggttggtcggttcgtcgagcagcagcaggtccggttcggacaccagggcctgggccagcaggacgcgacgacgccagccaccggacaactcggcgagggtcttgtcggccggcaactgcaggcggctcagggtgctgtccaccagggtctgcaagcgccagccgtcacgggcttcgaggtcgtgctggacgtgcatgagcttttccagatcggcatcggtgacgatgttctggctcaggtggtgatactgcgccagcaattcgccaacgccatcgaggccctgggcgaccacgtcgaacaccgtccgctcgtcggccactggcaattcctgcggcaattcgccgattttcagaccgggcgcgcgccatacggaaccgtcgtcgggcttctgatcgcccttgaccagcttcagcatgctggatttgccagtgccgttgcggccgatgatgcacacccgctcaccacgggcgatctgccaggacaccttgtccaacaacggcatagcgccgaacgcaagggacacatcgctgaatttgagcagggtcatgagcttctccaaaaaccgggcgcgcattctacctgagttgaggcctcagaaggccggcattttcattcctgaagcaccctgaacaacatttgcagcgaactggcgacaagaggccggcaaagctttcacccgctgctggcaaaaggctaagctagggaataatcagtgttggcattgtcggcacttgtcatgatttctctgcccggatgtctcatgcgcagtcgccttttcagtcttttgtcctgcctgcttctttctgcctctgccgtgcacaccgctcaggccgcagacctctcactccagcgtcaatattacgatgaagccaaacgcgccctggccaagggcgactccggcccgtatttccgctacagccaggtcctggccgactacccgctcgagccctatctggcctatgacgaactgaccgcccggctaaagaccgccagcaacgccgagatcgaaaagtttctccgtgaacacggcgacctgccccaggccaactggatgaaactgcgctggttacgctggctggccgaacgcggcgactgggccaccttcgtcaagtattacgaccccaagctcaacttcaccgagctggactgcctgaacgcgcaataccagctgggccacaacctcaaggccgaaggttacgccgccaccgacaagctctggctcagcggcaaatccctgcccgccacctgcgacgcgctgttcgcccagtgggccgccgaaggccagttgaccgaacagaagcgctggcagcgcgccaagctggctgccgaggcccgcaactatccgctggccaatagcctggtcaaaagcatgaccaccctcgcccctcagggccggctgctagtagacgttgcccagaagcccgagctgctcagccagccgtcgcgcttcactccggccagcgaagccatgtccgacgtggttggcctgggtctgcgccgcctggcccgccaggatcccgacagggccatggccctgctcgacggttatgccagcagcatgcacttctcccgtgacgaaaaagtggcgatcgcccgggaaatcggcctgaccctggcgcggcgcttcgacagccgtggccttgaagtgatgaccaaatacgatcccgagctgcgcgacaacacggtttccgaatggcgcctgcgcctgctgttgcgcctggctcgctgggaagacgcctaccagctgacccgcaagctgccccaggacctggcgaccaccaatcgctggcgctactggcaagcgcgcagcctggaactggccgaaccgcagaacccccaggcccagaccctctacaaaggcttggccaacgagcgcgatttctatggtttcctcgcggccgaccgtacccagttgccttatcagctgaacaacaaaccgctggcgctcagccagcaggtgatcaacaaggtgcgcaatacgcccggcgtgcggcgcgccctggagtttcatgcccgtggccagatcgtcgatggccggcgtgagtggtaccacgtcagccgtcatttcaaccgtgacgaaatggttgcccaggccaagctggcctatgacctgaaatggtacttcccggccattcgcaccatcagccaggcgaagtactgggacgacctggacatccgcttcccgatggcccaccgcgacaccctggtgcgcgaagccaaggtccgtggcctgcactcgagctggatcttcgcgatcacccgccaggaaagcgcgttcatggacgacgctcgttcgggcgtcggcgcggccggtctgatgcaactgatgcccggcaccgcgaaggaaaccgcacgcaagttcagcatcccgctggcctcgccgcagcaagtgctgaacccggacaagaacatccagctcggcgccgcctacctgagccaggtacacagccagttcaacggcaaccgggtgctcgcctccgccgcctacaacgccggccccggacgcgtgcgccaatggctccgtggcgccgaccacctgagcttcgacgtctgggtggaaagcattccgttcgacgaaacccgccagtatgtgcagaacgtactgtcctattcggtgatctacggccagaagctcaattcgccacagccactggtggattggcatgagcggtatttcgacgatcagtaagcgataacgcctcataaaaaatgcccgcagcgatgcgggcattttcgtttccagcgcaaggtcaggacacagactggccatcgctgaactgcaaggccgccaggcgcgcatacagtggattgctggcgatcagctcctggtgggtgcccaccgccaccagccgaccctgatccatcaccgcgatgcggtcggcgtttttcaccgtggccaggcgatgggcgatcaccagggtggtgcgattcttcatcaggctcggcaaggcttgctggatcaaatgctcgctctgggcatccagggcgctggtggcttcatccagcaacaggatcggcgcatccaccagcagggcccgggcaatcgccaggcgctggcgctggccgccggacagtcccagcccagcatcgccgagatgggtccggtaaccctcgggcatgttctcgatgaagtcatgggcgtaggcgatccttgccgcctccctgacctgctcctgggtggccgagggtttgccataacgaatgttctcctcgatgctgccgaagaacagcgccgggctttgcgacaccagggcaaaacagcgccgcacatcctgcgggtcgagttgtgtcaagggcacgccatcgagcaggatgcgcccctgctccgggtcgtagaaacgcagcagcagatcatagagggtcgacttgcccgcccccgacggcccgaccagcgccagggtttctccctcgtggatagtcaggctcaagccatcaacggcgtaactgtccggacgcgacggataagagaagcgcaagttctccagcaccagctcgccccgcacccgctcgggcaagctggccgggccgtcgctcggcggctggatcaggttttccgaacgcagcaactcggcaatccgctccgccgcgccggcggcccgttgcagctcgccgatcacctcgctcagggtgccgaaggcactgccgacgatcaggctgtagaagacaaaggccgccagctcgccactggaaatgcgcccggcgatcacatccatgccgccgacccagagcatcaccccgaccgcccccagcaccagcacgatcaccagggtgatcaaccaggcgcgctggacgatacgtcggcgcgcggtgttgaacgcctcttccaccgcctgggcaaagcgttgctcatcctgaggctggtggttataggcctggacggtcttgatctggcccagggtttccgccacgtagctgccgacatcggcgatacggtcctggctcaagcgcgacaggctgcgcacccggcggccgaaaatcaggatcggcgccagcaccaacggcaaggcgatcaccacgatgctggtgagcttggggttagtgacaaacagcagcacgatgccgccgatgaccatcagcgcattacgcaaaaacagcgagagcgacgagccgatcaccgattgcagcaaggtggtgtcggcggtcagccgcgactggatctccgagctgcgattgttctcatagaagcccgggtgcaggtagatcagatgattgaacacttgccgacggatgtccgccacgcaacgctcgccaatccatgacaccaggtagaaacgcacaaacgtccccaccgccagccccagcaccaataacagaaacaggccgatggactggttgagcaaatccggcgacccggtcatgaagccccggtccaccaacaggcggatgccctgccccatggacaaggtgatgcccgcggtcaccaccagcgccagcaacgcccccagggcctgccagcgataaggcgcgatgaaacgactggccaggcgaatcgcccggcgttgacgcgaagaaagcatgaagttcatccgggagcacacctgggaacggccccgccccattcaccgccacgtgatccagcaaggcgatgaggttgagccctgtttgtcggaaccgattttcctggagcctgcatttcctggaacctgcatttcctggaacttaggtaaatcaaaatgagtcaggttaattatgtccgccaacactagagcctagatgctattggtctaaggtccgagtggaagtccacagacatttctgttggactgaggactccccggatagaaaacgccgtagtgggaccttgcagggagttgtcacagcttggtcacctggcggttttaaagtaagcgcacaacctgatgaggagacaggccatgtccttgcaaaacagcagcaatgacaagattgaagtgattcgtacccaccccgaccagtctctgggatgcgccatcatcgacgctcagggtcgcgaagtaccgatcaccgaagacatgatccagaacgcctgccgcgaactggaaaagcgactggtcaagcctgctcagcaagattgacacatagcctcacgtcctcttgacccggccctgaagccgggttttttatgcctgccggaatccttgtcgccccgccacaagcgaccgggttcgagccatcaacgaaccgataccgcgcccaaggccgagacgatctgctgcaagcctggcgcttcgccctggatgcgcacggccaacccgtcgatttcacggcgcggcggataactcttgcgcaacgcatcgaaggccgcgcgctgctcggccacgctgcccaccaggctgcggcgaaaatccgcatcgtcgcgccgcgggtcgtagaccgcccgacagatcatcgccagggaccaggccggatcgctatgggcatcgaggctcacctccgacaaccatggccggggcagcaggtcgcgcagatgaatcgcttgcggctgcccgcggtcatcgcagagtgcctgatagatctgcgccgtcccgcgctgccggccatcaaggctgtaaccggcgatgtgcggcgtggccagtacgcacagctcggccagggccacgtcgacctggggttcgccttcccagacatccagcaccgcctgcaggtcttcacgctcgagcagcacttcacgcagggcagtgttatccaccaccgcgccacggctggcgttgatcagccaggcgccggggcgcagttgccgcaggcgctgcttgtccagcaggtgccaggtcggcagctcgccggccttggtcaagggggtgtgcaggctgatgacatcgcactgggcgaggatctgttccaggctgacgtagtcgccaccttccgccacctgccgtggcgggtcgcagaccaggaccttccagcccaggccgcgcagcacctcgatcagccgtccaccgacctcgcccgcgcccaccacgccgtacgtgcgttgcgtcaggtcggcgccttcgatttccgccagggtcagcaggctgcccagcacatagtcgaccaccccgcgcgcattacaacctggcgcgctggaccagcgaatacccgcctcgtggaaatactcgaggtccaaatggtcggtgccaatggtgcaggtcccgacaaaccgcacctggctaccctcgagcaaggcgcggctgacctgggtcaccgaacgcaccagcagcacatcggcgccctcgatggcggcgcggtcgatagcccgccccgggaaacggcggatctcgccgaagccggcaaaaaaggcatcgagcaggggaatattttcgtcggcaacaatcagcatggcaggctcctttcgcggagccgcagtttaggcgtagaaggccgtttggggccagcaagcaatccactccgtcaaccgccgccagcacttacaaatcgacaacagaggttttttcctgactcatccgtcaatgcgtagaatacgccgccctgcgcatcaaccctgtggacgcttcgcctgtgaattccgtgaccgatacctctgccacctccctcaaccgcccggcccgggtgcgccttgaactgcgcagcctgctggccctggccttgccgatcatgatcgcgcaactggcgaccacggccatgggcttcgtcgatgcagtgatggccggacgggtcagtccacaggacctggcggcggtggcgctgggcaactcgatctggatcccggtgttcctgttgatgaccggcaccctgctggccaccacgcccaaggtggcccagcgggtcggcgccggcacctatggcgagatcggcccgatcgtgcgccaggcgctgtggctggccctggcggtcggcctgagcgccagcctgattctgatcagtgccgagccggtgctgcacctgatgaaggtcgacccgacgctgatcggcccctgcatggaatacctgcacggcattgccagcggcctgccggcggtggcgctgtattacgtgctgcgttgctgcagcgatgccctgggccgcacccggccaagcatggtcatcggcctgttcggcctggccctgaacatccccatcaactacgtgttcatttatggccacctcggcgtgccggccatgggcggcgtcggttgcggctgggccacggccatcgtgatgtgggcgatgatgctggccatggcgggttggacccgctgggccccggcctaccagagcagccagctgttcaagcgtttcgactggccgcaatgggcggtgatcaagcgtttgctgagcgtcggcctgccgatcggcatcgcggtgttcgccgaatcgagcatcttcgcggtgatcgccctgctgatcggcagcctcggcgccacggtggtggccgggcaccaaatcgccctcaacatcagctccctgctgttcatgattccgtattccctgggcatggcggtcacggtgcgggtcggccaggccctgggcgccggcaacccgcatcaggcacgcttcgccgccggcgtcggcctgggcgcagcgctggcctttgccctgttctccgcgagcctgatcctgctgctgcgcgagtccatcgcctcgatctacaccccggacaccgcggtgatccaggtggcggcgatgctgatcgtgtatgccgcgctctaccagttctccgacgcgatccaggtgatctgcgccggcgcgctgcgtggctaccaggacactcgggtgaccatggtcctgacgctgctcgcctactggggtatcggcttgccggtggggtatgtgctggggctgaccgactggttcggccctgccagcggcccgagcgggctgtgggaaggcttgatcgccggcctgagttgcgcggcgctgatgctgtcgatccgcctggcgcgcagcgcgcgcaagcggatccgcatcagccgggcggcgggttaaccggacttcttgcgaatccagtacagataggtgccggcctcttcctgctgggcgaccagctcatggtcgaggaacacgcagaacttggggatgtcgcggcgggtcgagggatcggtggcgatcaccttgagcaggccgccgggctgcaggtcacgaatatgctggtgcagcatcatgaccggctccgggcaattgagcccggtggcatccagcgtgccgtcgaccggcgtatcgatgatttgactcataactcactcctgaaactggccggcattgtcgcgcaatgccggcatcgacgctatctgtggcattgcgccgcaaccacgatcaacgggccttgggcttcttttcatccagccggcgcaggtggcaggtcacttcttcgcggtcgtggtacagctgcttgcagccaatggctacacgaatgccacgcgccttgaaaccgtcctcgatccgctcgagcaaacgcttcacttccgcgtaacgctgcttcatcggcagcttcaggttgaccaccgcttcgcggcagtgcccctcgccgatccaggtttccagcaaggcggcgttgcgcgccggcttttcgacgatgtcgcagaccatccagtccaccggctgcttgggcttgaaggtgaaaccatcggccatcaggtgctgcaccaggccagtgtccatcaggctttcggccattggcccgttatcgacagcagtgaccagcatgccgcggttgaccagttgccaggtccagccacccggggccgcgcccaggtcgacgccagtcatgtcgccatgcagacgctcgtcccactgatcgcgaggaatgaaatggtgccaggcctcctccaacttcagggtcgagcggctaggcgcctcacgggggaacttcaggcgcggaatgcccatcggccacatggccgaattgcctgcgtccgccaggccgacaaacacctcgcggccgcttttgaaggtcagcagcaagcgcggcttgccggcatcgtccaccagcttgccggccgccgtcagggccttgcgcagcggtgcttcgaatttcttgcagaagttcgacagctccttgccgtcattggtatccagcacttccagccacaggctgccgcaggtcgggaagctcgccaggtgggccaggatcacgctgatgcggtcggtttccggtagatcgacgaagacgccccgcgcccattgccgcgggaagatcagctcggcgaaacgcagctcgcgcatcaggcgctcggcgccgtcttcttcgctgcacacaaactcggcacaggcggtgctcggcttggccttggcgtacccggccacgttcaggcgcgcggcatggtcggcgatctcggaacagacttcgccttcgaagcccggccggcagtgcataaagagggtgttcatcgaatctcctgggcaatgggcaatgaatcatgcgcaaacctgcccgaagtgcgcgcaaagcctgtcacgaaaaccggcgcatgatagccgagttcggaaccttggacttgtccatagagtccagttattagccagctactgaaaacagggctaggttaagagctctgcccgtcccgtcaggtccgtagccgtgcggaccaaaaggagtgattcaatgccgtccctcgatagcctgaaaacccttaaaacattaaaaatcgacgacaagacctaccactacttcagcctgccggaagccgccaagcgccttggcgatctcgacaaactgccgatgtcgttgaaagtcctgctggaaaacctgctgcgctgggaagacgaaaagaccgtcaccggcgccgacctcaaggctctagccgcctggctcaaggagcgccgctcggatcgcgagatccagtaccgcccggcgcgggtgctgatgcaggacttcaccggcgtgccggcggtggtcgacctggcggccatgcgcgcggccatggccaaggccggcggcgacccgcagcgcatcaacccgctgtcgccggtggacctggtgatcgaccactcggtgatggtcgacaagttcggcagcaacaccgccttcgaacagaacgtcgacattgagatgcagcgcaacggcgaacgttatgccttcctgcgctggggccagagcgccttcgacaacttcagcgtggtgccgccgggcaccggcatctgccaccaggtcaacctggaatacctgggccgcacggtctggaccaaggacgaagacggccgcacctacgccttccccgacaccctggtcggcaccgactcccacacaaccatgatcaacggcctcggcgtgctcggctggggcgtgggcggcatcgaggccgaggcggcgatgctcggccagccggtgtcgatgctgatcccggaagtcataggtttcaaactgaccggcaagctcaaggaaggcatcaccgccaccgacctggtgctgaccgtcacccagatgctgcgcaagaaaggcgtggtcggcaaattcgtcgagttctatggcgacggcctggccgacttgccactggccgaccgcgccaccatcgccaacatggccccggaatacggcgccacctgcggcttcttcccggtggatgacgtcaccctggaatacctgcgcctgtccggccgcccggacgccgtggtgaaactggtggaggcctacagcaagacccagggcctgtggcgcctgccgggcaaggagccggcattcaccgacagcctggcgctggacatgggcacggtggaagccagcctggccgggccgaagcggccgcaggaccgagtctccctgcccaacgtcggccaggccttcaccgactttctcgatctgcagttcaagcccaccagcaaggaagaaggccgcctggaaagcgaaggcggtggcggcgtggccgtgggcagcgccgacctgataggcgaagtcgattacgcccacaatggccagacctaccgcctgaaaaacggtgcggtggtgatcgccgccattacctcctgtaccaacacctccaaccccagcgtgatgatggccgccggcctggtggcgaaaaaggccgtggaaaaaggcctcaagcgcaagccctgggtgaagagttcgctggccccgggttcgaaagtggtcaccgactactacaaggccgccgggttgacccaatacctcgacgccctgggcttcgacctggtgggttatggctgcaccacctgcatcggcaactccggccccttgccggagccgatcgagaaagccatccagaaagccgacctgaccgtcgcctcggtgctgtccggcaaccgcaacttcgaaggccgcgtgcacccgctggtgaaaaccaactggctggcctcaccgccgctggtggtggcctatgccctggccggcagcgtgcgcatcgatatcagcagcgaaccgctgggcgaaggcaaggacggcaagccggtctacctacgcgacatctggccgagcagccaggaaatcgccgaggccgtcacccaggtcaacacccggatgttccacaaggaatacgccgaggtgttcgccggcgatgcccagtggcaagccatcgaagtaccgcaagccgcgacctacgtgtggcaggcggattccacctatatccagcatccacccttcttcgacgatatcgccggcccgctgccggtgatcaaggatatcgaaggcgcgcgggtcctggcgctgctgggcgactcggtgaccaccgaccacatttccccggccggtaacatcaaggccgacagcccggccggccgctacctgcgcgagcagggcgtggaaccgcgggacttcaactcctacggttcgcgtcgcggcaaccatcaggtgatgatgcgcggcaccttcgccaacatccgcatccgcaacgaaatgctcggcggcgaagaaggcggcaacacgatctacatccccaccggcgagaaactggcgatctatgacgcggccatgctgtaccagcaatcgggtacgccgctggtggtgatcgccggccaggaatacggcaccggctccagccgcgactgggccgccaagggcaccaacctgctgggggtcaaggcggtgatcgccgagagcttcgagcgcatccaccgctccaacctggtgggcatgggcgtgctgccgctgcagttcaagctcgatcagaaccgcaagagcctgaacctcaccggcaaggaaaccctggatatccagggcttgaccggcgtcgagctgacgccgcggatgaacctgaccctggtgatcacccgcgaggatggcagccaggaaaaggtcgaggtgctgtgccgcatcgacaccctgaacgaagtggaatacttcaagtccggcgggatcctgcactacgtcctgcggcaactgatcgccgcgtaacgccatgccgcaacaccaacaccgcctacgggcggtgttttttgtttcacttattcatcgcccgcgcctcgttatactggcggcccgctcgttctatccagtaaccgccccgacgcaggttgcgcgagcggctgattccattcttcgcaacagggatttcacatgactgttctgccatggatgtacctggcacttctctccattggttacgccctggccctgagctacggccaactgggcctgctggcggcggtttccgtcgccttgctgctgtgcgcgggctttgccgtgcgccagcagaagagcccttacgcgcgctatctgggacacggcctgttcgtggtgctggccctggcgctggccatgcactggctccccggtttctacaatggccgggcgatcggcccgcaacgcttcaccgccgatgccgtgccgttttccatgtacctgaaccaggacaagccgctgatcggcttctggctgttgctggtctgcccctggatcatcgggcgccgctcgctgcgcctgtccctctacaccaccgccctggccttgaccctgaccgccctggcggccctgggcggcgcagtgttgctgggcatcatcagttgggcgccgaaatggccggaccaggcctggctgtgggtgctgaacaacctgctgctggtcaccctggtggaagaagcgctgttccgtggctacatccagggcggcctgagccgtcgcttcaagcacctgccctatggtgaaaacctggcgctgatgtgcgcggccctgctgttcggcctggtgcatgtgggcgccggctggcaatggtggctgctggcgagcatcgccggggtaggctacggcctggcctaccgctttggcggcctgggcgccgcggtggccacccatttcggcttgaacctgctgcacttcgggctgttcacctacccgatgctcgcgggttgaccctggccaagccggggctccctggacggacctcggcttcgccgcttcccctcgcccctccttgcagaatcaggcctctgtcaatgaggcacttctcaaattactgaaaaaaacttcaacaattggcgaaggccgccgacaacctaccaaagccttgcggattgaaaaaccatgcgtaacaaccagcccgtcacccagcgcgaacgtacctttccagctcagcaacggttgatctccaccaccgatgccaaaggcgtgatcacctactgcaacgatgccttcgttgaaatcagcgggttttctcgtgaggaactggtccgcgcaccgcacaacctggtccgtcaccccgacgtcccggccgcggtgttcgcgcatatgtgggccaccctgaaacaaggcttgccatggatgggcattgtcaagaatcgctgcaagaccggtgaccactactgggtcaacgcctacgtgacaccggtcttcgaaggccagcaagtggtcggctacgagtcggtgcgggtcaagcccaccgccgagcagatccgccgggccgaagcgctttaccaacgcatcaaccagggcaagtcggccattccgaaacgcgacaaatggctgccgatacttcaggactggctgccattcatcctgatcagccagctgagtttcctgattggcgcctggctcaattcttcctggggctttgccctcgccgccggcctttgcgtgccgctcggcctgctcgggctgagctggcaacagcgcggcctcaagcgtttgctgcgcctggccgaacagaccacctccgacccgctgatcgcccagatgtacaccgacagccgtggcgcccaggcgcgcctggagatgtcgatcctcagccaggaagcccgcctgaaaacctgcctgacccgcctgcaggacaccgccgagcacctcaacgagcaggcgcggcagtccgacaccctggcgcacaacagctccagcggcctggaacgccagcgcgtggaaaccgaacaggtggccaccgcggtcaaccagatggccgccaccacccaggaagtggccagccacgtgcagcgcaccgccgatgccacccaggaagccaaccgcctcaccgggcgcggtcgcgatatcgccggggaaacccgcgaagcgatccagcgcctatcggtggtggtgggcgaaaccggcctgaccgtgacccagctggccaaggacagcgacgaaatcggtggcgtggtcgatgtgatcaagggcatcgctgaccagaccaacctgttggcattgaacgccgccatcgaagcggctcgcgccggggaaatgggccgcggcttcgcggtggtggccgacgaggttcgccaactggcgcaacgcaccagcgaatccaccgggcagatccacaccctgatcgccaagctccagcaaaccgccagcacggcggtgcagaccatggacgccggacaccgtcaggccgaggaaggcgtggcccgagtgctggaagccgaccaggcgctggtgggcatcagcgaagcggtggccaacatcaccgacatgaccacccagatcgccgccgccaccgaagagcaaagcgccgtggccgaggaaatcagccgcaacatcagcaccatcgcccagctggccgaccagacctcggagcaggcgcagcattcggcgcaactcagcgaagagctgacccgcaccgccaacacgcagtactcgttggtcgaacgcttcaaccgctaagccgaagccagacaaaaaacccggaaggttcgccttccgggttttttattgcctgttttcaagtaccacgcgtgcattttctgtaggagcagccggtcgacgctcgattgctcgcgattgtttttcaaggcgacaacgatggcgactgccaggccgcatcgcgagcaagcttcgctcctacagtgaaaacgcgttcagccattcaactggcgcaagacctcggcaatcttctgcgccgccgcttccaggtgctgctcatgggtgaagcctgaggccttgagcggtttcaggtcatggtcggccgccgccagccagaacagctcgatagccggcgccagcgcataggcttcgaccgccgcacggttgccgagggcgtcgcgctcgccctggacgatcagggtcgtggtgcgcaattcggccaggtgggcgacccgcggtttctccggcttgccggccgcataaaacggataccccaggcacaccagcgcatcggcgcccagctcgtcggcgagcaaactggccatgcgcccgcccatggacttgccgccgatggccaaccgcccagcgacatgaggtcgcacctgggcatacacctcgcgccagcactccagcagcttcggcgccgggttaggcggccgtttgccaccatcgaggcgacgctgggccatgtagggaaactcgaagcgcaggacgttgaccccatgcgccgcaaggcgtgcggccatatcgttcatgaaagcgctgtccatcggcgcgccagcgccatgggccaggatcagggtcaggggttcgccggccagcgactgctgcgcgacatcccagagccagccccgttcccgcacgcactgcgcccattgatccccgtcaataacagccccttgccgtttgcccatgcttacctcgcttttagtctgcctataactccagaagaagtgagcgcgccttgccgtgcgcagtcgctttcacttcagctgaaccgtggatggggaaccatgaacacttctatcagtaccgcctacaactacaaggtggtccgccaattcgccattatgacggtggtgtggggcatcgtcggcatggggctcggggtttttctcgctgcccagttggtctggcccgaactcaacttcaacctgccctggaccagtttcggtcgcctgcgcccgttgcacaccaacgcggtgatcttcgccttcggtggctgcgcactgttcgccagctccttctactcggtgcaacgcacctgccagacccaactgtttgcgccgaaaatcgccgcgttctgcttctggggctggcagctggtaatcctcctggcggccatcagcctgccgctgggctataccagctccaaggaatacgccgagctggaatggccgatcgacatcctcatcaccatcgtctgggtggcgtacgccatcgtgttcttcggcacggtgatgaagcgcaacaccaaacacatctacgtcggcaactggttcttcggcggcttcatcatcaccgtggccatcctgcacatcgtcaacaacctggaactgcccgtcagcctgaccaagtcctactcggtgtatgccggtgcgaccgacgccatggtccaatggtggtacggccacaacgcggtgggcttcttcctgaccgcgggcttcctggggatgatgtactacttcgtgcccaagcaggccgaacgtccggtgtactcctaccgcctgtccatcgtgcacttctgggcgctgatcaccctgtacatctgggccggcccgcaccacctgcactacaccgcgctgccggactgggcgcagtcgctgggcatggtgatgtcgctgatcctcctggcaccgagctggggcggcatgatcaacggcatgatgactctgtcgggtgcctggcataagttgcgcagcgacccgatcctgcggttcctggtggtgtccctggcgttctacggcatgtcgaccttcgaaggtccgatgatggcgatcaagaccgtcaacgccctctcccactacaccgactggaccatcggccacgtccacgccggcgccctgggctgggtggcgatgatttccatcggcgcgctgtaccacatgatcccgaaagtcttcggtcgccagcagatgcacagcatcggcctgatcaacgcgcacttctggctcgccaccatcggcaccgtgctctacatcgcctcgatgtgggtcaacggcatcgcccagggcctgatgtggcgcgccgtcaacgaagacgggacgctgacctactccttcgtcgaaaccctggtggccagccacccaggcttcatcgtgcggctggtcggtggcgcgatcttcctcttcggcatgttgctgatggcctacaacacctggcgcaccgtgcgcgcggcccagcctgccgaaatcaccgccgctgcgcagatggcctgaggagtccgccatgaaacacgaagtcatcgagaaaaacgtcggcctgctgatgctgctgatggtatttgccgtgagcatcggcggtctgacccagatcgtcccgctgttcttccaggacgtcaccaacaagccggtggaaggcatgaagccctacaccgccctgcaactggaaggccgcgatatctacatccgcgaaggctgcgtcggctgccactcgcagatgatccgcccgttccgcgccgagaccgaacgctacggccactactcggtcgccggcgaaagcgtctgggatcatccgttcctgtggggctccaagcgtaccggtccggacctggcccgggtcggcgcccgctactccgacgactggcaccgcgcgcacctgtacaacccgcgcaacgtggtgcccgagtcgaagatgccggcctacccatggctggtcacccagccggtcgacagcagccacaccgagaccaagctgcgcgccatgcgcaccctcggcgtgccgtacaacgacgacgatatcgccggtgccgtcgcctccctcaagggtaagaccgagatggacgccctggtcgcctacctgcaagtgcttggcactgcgatcaagagcaagaggtgagccatggttcttgaactcgatagcggcatgatccgcgggctcggcacgctggtggtgatgattgccttcatcggcctgtcgatctgggtcttcaacgccaagcgcaacccggagttcgcccaggcgcgcctgctgccttttgccgacgaaccttcgccgcaagtgcacggcaatccatctgatgacgctcaatccgaagagcacgcgacaaggagcattcggccatgaccaccttctggagtacgtacatctgcgtactgaccataggcagcctgatcggcctgacctggctgttgatcggcacgcgcaagggcgagaccaagggcagcgtcgaccagaccatgggccacagcttcgacggcatcgaggagtacgacaacccgctgccgcaatggtggttcatgctgttcgccggcaccctggtgttttccgtcggctacctgatcctctacccgggcctgggcaactggaaaggcatcctgcctggctatgaaaacggctggaccggcgtgcacgagtgggaaaaggaaatggacaaggcagacgccaagttcggcccgatcttcgccaagttcgccgccatgcccgtggaagaagtggccaaggatccgcaggcgctgaaaatgggcggacgcctgttcgcttccaactgctcggtgtgccacggctcggatgccaagggcgccttcggcttccctaacctggccgacaacaactggcgctggggcggcaacgccgacaccatcaaggccaccatcatgggcggtcgcatggcggccatgccggcctggggtgaagtgctgggcgaggacggggtgaagaacgtcgcagcctatgtgcgtcacgaactcgccggcctgccgttgcccgccgacagcagcgccgacctggttgccggcaagcaggcgttcagcaccacctgcgtcgcctgtcacggcgccaatggccagggcacggaaatcatgggcgcgccgaacctgacgcaaccggcgggcttcatctacggcaccagcctgacccagctgcaacagaccattcgccacggtcgccagggccacatgccggcgcagagcgaactgctgggcaacgacaaggtgcagctgctcgcggcctacgtctacagcctgtcccacaacgcggccagccagccgcagaccgaaaccccaagcgagcaataaccgctccacccactgccgcatcgctcgatgcggcagttccctgcctctgcgcgaccaagtgtcgcaccctctctaccctctgcctttccactctccggattcaggtctaagctgcttcgcagtggactggcaatggccggtcacagaccagaagtagccgttccattcgaagccgtcgttcgaggacaggccgcaaaggctggtgtataccggctgtcgtgccacttaccgtctgtcgctcgttgaatggctttccacacacccggttacaactgacctgtacccctcgcctttttcatccgctgcgacattttgtcctgggccgattttgtccttactccgcgcatggaaaggccgcagaatcagcttttgaaagcattgacccaggtcatggcgcgttgcaatgaccccctgctttctccatacttgcggccgatttttactcctaataaaacacccaaaccgtggaaccttagaatgagcacagcaatcagtccgactgcttataactataaggtagtccgccagttcgccatcatgacggtggtctgggggatccttggcatggggctcggtgtcttcatcgcctcgcaactggtctggccggagttgaacttcggtctgccatggacgacctttggacgcctgcgcccgctgcacaccaacctggtgattttcgccttcggtggatgtgcattgtttgccacttcttactacgtcgtgcagcgaacctgccaaacgcgactgatttccgacagcctggcggccttcaccttctggggttggcaagccgtgatcgtcggcgcgatcgttaccttgccgctgggttacaccaccaccaaggaatacgcggaactggaatggcccctggctatcctgctggccatcgtctgggtcacctacggtctggtgttcttcggcaccatcgtcaagcgcaagaccaagcacatttatgtgggtaactggttctacggtgccttcatcgtggtcaccgcgatgctgcacatcgtcaaccacgcttccctgccggtcagcttcttcaagtcctactcggcctactcgggtgcgaccgacgccatgatccagtggtggtacggccacaacgcggtgggcttcttcctgaccaccggcttcctggggatgatgtactacttcgtgccgaaacaggccgagcgtccgatctactcctatcgcctgtccatcgtgcacttctgggcgctgatcaccctgtacatctgggccggtccgcaccacctgcactacaccgcgctgccggactgggcgcagtccctgggcatggccatgtcgatcatcctgctggcaccaagctggggcggcatgatcaacggcatgatgaccctctcgggcgcctggcataagctgcgcaccgacccgatcctgcggttcctggtggtgtccctggcgttctacggcatgtcgaccttcgaagggccgatgatggcgatcaagaccgtcaactcgctgtcgcactacaccgactggaccatcggccacgtacacgccggcgccctgggctgggtagcgatgatctcgatcggcgccctgtaccacatgatcccgaaagtcttcggtcgccagcagatgcacagcatcggcctgatcaacacccacttctggctggcaaccatcggtaccgtgctctacatcgcctcgatgtgggtcaacggcatcacccagggcctgatgtggcgtgcaatcaacgatgacggcaccctcacctactccttcgtcgaagccctgcaggccagccaccctggtttcatcgtgcgcgccctgggcggtgcgttctttgccgccggcatgctgttcatggcgtacaacgtgttccgcaccgttcgcgcctcgaacccggctgaagctgaagccgccgctcagatcgctgtagttggagctcactgatgaagcatgaagcagtagagaagaatatcggcctgctggccttcttcatggtcatcgccgtcagcatcggcggcctgacccagatcgtcccgctgttcttccaagacgtcaccaacaagccggtggaaggcatgaagccgcgcaccgccctggaactggaaggccgcgacgtctatatcgccaacggctgtgtcggctgccactcgcagatgatccgtccgttccgtgccgaaaccgaacgctacggccactactcggtcgccggtgaaagcgtctgggaccacccgttcctgtggggttccaagcggaccggtccggacctggcccgcgtcggtggtcgttactccgacgactggcagcgtgcgcacttgtacaacccgcgcaacgttgtacccgagtcgaaaatgccggcttacccgttcctcgtagaaaacaagctcgacggcaaagacaccgcgaaaaaaatggaagtcttgcgcacgctcggcgtcccttacaccgacgaagacatcgccggtgccaaggatgccgtgaagggcaaaaccgaaatggacgcgctggtggcctatctgcaaggcctgggcaccatcatcaaaagcaaacggtgatttagatggatatcgggatgattcgtggcctgggcaccgtagtggtgatggtggcctttatcggcctggcgctgtgggtattcagccccaagcgcaagtccgagttcgaagacgcgaccttgctgccgttcgcggatgatcccgaagccatcaagcacgtcgagcaagcttctaggagtaacaaagaatgactacgttctggagtctgtacgtcacagtcctcagtctgggtaccattttcgccctgacctggctgctgctgtcgacccgcaagggccagcgcgccgagcagaccgacgagacggtcggccacgccttcgacgggatcgaggagtacgacaacccgctgccgaaatggtggttcatgttgttcgtcggcaccatcgtcttcgccctgggttacctggtgctctacccgggcctgggcaactggaaaggcctgctgccaggctacaactacctggacaccgaaaagcagacccccttcgccaacggccagaccggctggaccggcgtgcacgagtgggaaaaggaaatggccaagtcggacgccaagttcggtccgatcttcgccaagttcgcctccatgccgatcgaagaagtcgccaaggacccgcaagccctgaagatgggtggccgcctgttcgcctccaactgctcggtctgccacggctccgacgccaagggcgcctatggattcccgaacctgaccgacgccgactggcgctggggcggcgagccggagaccatcaagaccaccatcatgggcggtcgtcacgcggtgatgccagcctgggccgaagtcatcggcgaacaaggcgtcagcgatgtggccgcctatgtactgaccaacctcgatggccgcaagctgccggaaagcgccaaggccgacccggccaacggccagaagatcttcgccgccaactgcgtggcgtgccacggtccggccggtaaaggtaccccagccatgggcgcgcctgacctgacccacccgggcgcgttcatctacggctcgagcttcgcccaactgcagcagaccatccgttacggccgccagggccagatgcctgcccaggaacagctgcaaggcaacgacaaggtccacctgctggccgcttacgtctacagcctgtcccacagtgacaagccggcggacgccgagtaaagcagacaccttcgggtaacagaaaaggccccgccaatgtccattggcggggcctttttattttcctctccccctcacgtccgtcgctctgcccccgcttgagattgccgcctccccgccaagagtagtaacgttgctacatgaaatttttgtcgagggtatgacgatgcctaccaccaccatctccagtcgcgaattcaatcaggacacaagtggtgccaaaaaagcctcaagaaacggccctgtcatcatcaccgaccgtggcaggcccgcccatgtgctgctaagcattgaggactacgaaaaactgagcggcctgaacaccagcatcgtcgacatgctggtcatgcctgaagcgcctgaaatcgatttcgaaacagagcgcgcaaccatcattcctcgcgagatcgatctgtcctgatgtttttgctcgataccaacgtcgtgtccgaattacgcaagcccaacgctgatcgcaaggtagtggcctgggttcagaccgtggcgccaaccagcctgtttttgtcagtcattacgttattggaactggaaaccggcatcctgcggttggaacgccgcgatcgcactcaaggggcacggctacgtgcctggctggaactgcacgtgatgcctgctttcgacggacgaatactggccattgaccctgctgtcgcgatgcgctgcgcccgattgcacgttcctgattgcagtaatgaatgcgatgccctgattgcggcgaccgccctggaacatgggctgacagtcgttacccgcaacatcgccgacttccagtccagcggtgtgcagctgctcaacccgtggaacgattgaacgcggtcgcggcgaaaagcgtccataattcacaagtcaattgattcaagtcattacaccatcaattgatttcccccaacgcgaccaaaggtcgcacccttgagctagagcgacaggcgtatcattgcgccactgcaacacccctatttgatcgcggtcggcacgtactgaccggggcatttctccactgccgtgggatgcaatgatgagcaaccagattccggtacatgacgtcacccctcctgccaagaattcgaacaacagcgtagacctctacgcctctcgggaaaaaatctacacacgcgctttcaccggcctcttccgcaacttgcggatggtgggcggggcggccctgttcctgctgtatttcggtacggtgtggctcaactggggcggccaccaggccgtctggtggaacctgccggagcgcaagttcttcatcttcggcgccaccttctggccccaggatttcatcctgctgtcggggcttttgatcatcgccgccttcggcctgttcttcatcaccgtgtatgccgggcgcgtctggtgcggctatacctgcccgcaaagcgtctggacctggatcttcatgtggtgcgagaaggtcaccgaaggcgaccgcaaccagcgcatcaagctcgacaaggcgccgatgagcgccaacaagttcctgcgcaagttcagcaagcacagcctctggctgctgatcggcttcgtcaccggcatgaccttcgtcggctacttctcgccgatccgcgagctggtcatcgacttcttcaccggccaggccgatggctggtcgtatttctgggtcggcttcttcaccctcgccacctatggcaacgccggctggttgcgcgaacaggtgtgcatctacatgtgcccgtacgcccgcttccagagcgtgatgttcgacaaggacaccctgatcgtctcctacgacccgcgtcgcggcgaaggtcgcggcccgcgcaagaaaggtgtcgactacaaggccatgggcctgggcgactgcatcgactgcaccatgtgcgtgcaggtctgcccgaccggcatcgacatccgtgacggcctgcagatcgaatgcatcggttgcgccgcctgtatcgatgcctgcgacaacatcatggacaagatggactacccgcgcggcctgatcagctacaccaccgaacacaacctgtccgggcagaaaacccataaactgcgtccacgcctgatcggttatgcgctggtgctgctggcgatgatcagcctgctggtcacggccttcttcatgcgttcgctggtgggcttcgatgtcagcaaggaccgcgtgctctatcgcgagaacgccgaaggccggatcgaaaacgtctacagcctgaagatcatgaacaaggaccagcgcgaccatacctacgtcctggacgccgccggcctgccggacctcaagctgcaaggccggcgcgagatcaaagtggcggccggcgatatcgtcagcatgccggtcgaactgtcgagttcgccggaacaactgccgtcgagcaccaacgaggtgaagttcatcctcaaggacgccgacgacgaaagcgtccacgttgaagccaagagccggttcatcggcccacaaattcgttaagagaagtcatcatgcccgcagcgaccgccacaagcccctggtacaagcacctctggccctggatcatcatcggtatcctggcctgctcggtgaccttgaccctgtccatggtgaccatcgcggtgaacaacccggacaacctggtcaacgacaactactacgaggccggcaaaggcatcaaccgctccctggaccgcgagctgctggcccagaccctgcaactgcgcgccagcgtgcacctggatgacctcaccggcgaagtcgacctgcgcctgggcggcaacagcgcgcccgctaccctggagctgaacctgatctcgccgacccagccggaaaaagaccgcaagatcaccctcgcccgcagcgaaaccgaacagggccgctacattggccagttgagcgacaaggtcgatggccgccggtttgtcgaactgctgggtgtcgaaggcgacaagacctggcgcctgttcgaagaggaacaggtcagccacgacaaggacctgctgctgggtgatgaaccgctgcaaggcgcggaacacctggacaagtaagcgccctccgaacatcgccggcaggctgctgcttcccaggcagcggcctgccggcgatgaggtccgcccctggaacaaagacccgcgatgaccacgccactgccctgctaccactgcgccctgcccgtccccgccggcagccgcttcaccgccgtcgtgctcggcgctccccgcgagttctgctgcccgggctgccaggcggtggccgaagccatagtcgccggcggcctggagagctactacagccatcgcagcgaagcctcggccaacccggaggcgctgccggtgcaactggtggacgaactggcgctgtacgaccgggcggacgtgcagcaacccttcgtccggcatgagggcgagctggccgaaaccaccctgctgatggaaggcatcagctgcgccgcctgtggctggctgatcgagaaacacctgcgcagcctgccggcggtggccgaggcgcgactgaacctgtccaaccatcgcctgcatgtgcgctgggccgacagccagttgccactgagccaggtgctcagcgagctgcgcctgatcggctacgccgcgcacccctatcaggccgaccgtgcttccgagcaactggccagtgaaaaccgcctggccctgcgccagctgggcgtggccgggctgctgtggttccaggcgatgatggcgaccatggccacctggccggaattcaatatcgacctgagccccgagctgcacaccatcctgcgctgggtcgcgctgtttctcaccacgccgatcgtgttctacagctgcgcgccgtttttcaagggcgccctgcgcgacctgcgcacccgccacctgaccatggacgtttccgtgtcgctggcgattggcgccgcctacatcgccgggatctggacctcgatcactggcgtcggcgagctgtacttcgatgccgtgggcatgttcgccctgttcctgctggccgggcgctacctggaacgccgtgcccgcgagcgcaccgccgccgccaccgcacaactggtgaacctgctgccggcctcatgcctgcgcctgggcgccgacggccagagcgaacgcatcctgctcagcgaactgcgcttgggggacaaggtgctggtgcatcccggcgccatcctgccggccgacggcaagatcctcgatggccagtcgagcatcgacgaatccctgctcaccggcgaatacctgccgcaaccacgcagcatcggcgatgcggtcaccgccggcaccctcaatgtcgagggcgcgctgaccgtggaagtcctggcgctggggcaggacacgcgcctgtcagccatcgtccgcctgctggaccgggcccaggcggaaaaaccgcgcctggcggagatcgccgaccgcgccgcccaatggttcctgctgttctccctgatcgccgcggccgccattggcctgctctggtggcagctggacgcctcccgagccttctggatcgtcctggccatgctggtcgccacctgcccctgcgcgctgtccctggccaccccgaccgcgctgaccgccgccaccggcaccctgcacaaactcggcctgctgctgacccgcggccatgtgctcgaaggcctgaaccagatcgacacggtgattttcgacaagaccggcaccctcaccgagggacgcctggccttgcgctcgattcttcctgtgggcgacctcgacagccagcagtgcctgggcctggccgccgccctggaaaaccgttccgaacacccgattgcccgggccttcggccgtgcgccgctggccgcggaagaagtgctgagcatgcccgggctgggcctggaagggttggtgggcgaacaacgcctgcgcatcggccagcccgccttcgtctgcgagctcagcgcctgtgcggtcccggcgatgccggacgaagccggccaatggctgctgctgggcgatagccaagggccgctggcctggctggtcctcgacgatcgcctgcgcagcgatgctccggcgctgctggccgcctgcaaggcgcgcggctggaacaccctgctgctctcgggcgacagctcgccgatggtcgccagcgtcgccgccgaactgggcatcgacgaagcccgcggcggcctgcgcccggacgacaagctgcaggtgctgcagcaactgcatcgccagggtcgcaaagtgctgatgctcggcgatggggtcaacgatgtgccggtgctggccgccgccgatatcagcgtggccatgggctcggccaccgacctggccaagaccagcgccgatgcggtgctgctgtccaaccgcctggatgcgctggtgcaggccttcggcctggcccgccgcacgcgccggataatcatcgagaacctgctgtgggccgggctgtacaatggcctcatgctgccgttcgccgccctcggctggatcactccggtatgggccgccattggcatgtccatcagttcgttgaccgtggtgctcaatgccctgcgcctgactcgcctgccgggccagccccaggccgaggccacgacccaaacccgcccgctgccggcctgagccgcgcgggcatggagcctacccatgccagctctctacgtgatgattccggcggcgctgctgatcgtggccatcgccatctacatcttcttctgggcggtcgacagcggtcagtacgacgacctcgacggccccgcccacagcattctgttcgacgaccaggaccccaagcacaccgccgcggtcgacgaggccaagggctcaccgacggccgagcaaccaccgcacaaagaccaggcgccgccccatgcttgagctggcaccgctgctggtttccgccgtgattctcggcctgctcggcggcggtcactgcctgggcatgtgcggcggcctgatgggcgccctgaccctggccattccccaggagcagcgcagccggcgttttcgcctgctgctggcctacaacctggggcgcattctcagttacgccaccgcgggcctgctgatcggcctggccggctgggccgtggccagcagtccggcggccatggccctgcgtgtgctggccggcctgctgctgatcgccatgggcctgtacctggccggctggtggagcggcctgacccgcatcgaaagcctcggacgcggcctgtggcgccatatacagccggtggccaaccgcctgctgccggtgtcgagcctgccacgcgccttgctgctgggcgcactctggggctggcttgccgtgtaggcctggtctacagcaccctgctgtggtccgccagccagggcaatgccctcgacagcgccttgctgatgctggccttcggccttggtacctggccggtgctgctggcgaccgggctcgcagcggaacgggtcaccgcgctgctgcgccggcgcagcgtgcgcatggccggtggcctgctggtgatcctgttcggcatctggaccttgcccggtccgcatcagcattggttgatggggcactgaggcaacccttcccgctgcctccgcccttcggcagcgacgacgcaagactcgcatgacaggctccgcgccccgccagccttgatgcaaatcaagatggtccgggcgccaaccccctagactcgcgaacactgcctgcctaccgggggaattcccgcatgctcgacgccattcgttgggacaccgatctgatccgccgttacgacctggcgggaccgcgctacacctcctaccccaccgctgtgcaattccacagccaggtgggcaccttcgacctgctccacgccctgcgcgagagccgcaaggcgctgcgcccgctgtcgctgtacgtgcatgtgccattctgcgcgaacatctgctactactgcgcctgcaacaaggtcatcaccaaggaccgcgggcgcgccctgccctacctgcagcgcctggaacaggaaatccagctgatcgcctgccatctcgaccccgggcagaaggtcgagcaactgcacttcggcggcggcaccccaacctttctcagccacgacgaactgcggcagctgatgagccacctgcgccagcacttcaacctgctggacgacgattcgggcgactacggcatcgagatcgacccgcgcgaagccgactggtcgaccatgggcctgctgcgcgagctgggcttcaaccgcgtcagcatcggcctgcaggacctcgatccggcggtgcagcgcgcggtcaatcgcctgcagagcctggaggaaacccgggcggtgatcgaagcggcgcgcaccctgcaatttcgctcgatcaacatcgacctgatctacggcctgccaaaacagacgccggacaacttcgcccgcaccgtcgaggaagtcatcaacctgcagccggaccggctgtcggtgttcaactacgcgcatctgccggagcgcttcatgccgcaacggcggatcaacagccacgagctgccggaaccggcggaaaaactgcagatgctgcagcgcaccatcgaacaactgacggccgcgggttaccgctacatcggcatggaccatttcgccctgcccgacgacgagctggcgatcgcccaggaagagtcaaccctgcaacgcaacttccagggctacaccacccacggccactgcgacctgatcggcctgggcgtctcggccatcagccagatcggcgacctgtactgccagaacagcagtgacctgacccagtaccagaacctgctgggcggcgcgcaactggccaccagtcgcggcctggtatgcaatcaggacgaccgcgtcaggcgcgcggtgatccagcagctgatctgcaatttcagcctcgacttcgaggccatcgagcagcagttcaacatcgactttcgcggttacttcggcgacctctggccgcaactgcaagccatggccgaagacggcctgatcaagctgagcaaccaaggcattgaagtgctgccggccgggcgcctgctggtgcgttcggtgtgcatggtgttcgacacgtatctggagcaacagaatcgacagcgtttttcccgggtcatctagggcgtcatgagccgcgacctgaccgttcagcgcgacaacttgtcgcaggtggcaggcaaaaactgtctggatagacaaggcgcaaacaagcctgatacttgacgctgggataatcggcggctgcaagtgacggtcagcgctggaaataccctgaatggactgcacgagcgcattttcccgcagtggcctggaggctacaaacggacagctttacgactaagcgccaatacggcacggactggccggaacctcctcccgtgagttacccttacggcttatgtgtgttttcccacaaggattctattgaatgtccgagccagtaaaactgcgcgctcacaaccaggcccattgcaaggattgcagcctggcccccctctgcctgccactttctctgaatctggaagacatggatgcgctggacgaaatcgttaaacgcggccgcccgctgaaaaaaggcgagttcctgtttcgccagggcgacgccttcgactccgtctatgcagtgcgctccggtgcgctgaagactttcagtctcagcgacggcggcgaagaacagatcaccggcttccacctgcccagcgaactggtcggcctgtccggcatggacaccgagatccacccggtttccgcccaggccctggaaaccacatcggtctgtgaaatccccttcgaacgcctcgacgaactggccctgcagttgccccaactgcgccgccaactgatgcgggtgatgagccgcgagatccgcgacgaccagcagatgatgctgttgctgtcgaaaaagaccgccgacgagcgcatcgccaccttcctggtcaacctgtcggcacgcttccgcgcccgcggcttctcggccaaccagttccgcttgagcatgtcgcgcaacgagatcggcaactatctgggcctggcggtggaaaccgtgtcccgggtgttcacccgcttccagcagaacgcgctgatcgccgccgaaggcaaagaggtgcacattctcgatccgatccagctgtgcgccctcgccggcggctccctggaaggctgaggcagagcccccgcccgagccaagcggctcgggcggggctatactggcgcgctccacttcatgcccgccaggacaccgccacgatggccttcgactccttcgacatcaaatccctgatccgcccagtcatcgacttccccaagccgggcgtgatcttccgagatatcactcccctgttccagtcgcccaaggccttgcgcctggtcgccgacacctttgcccagcgttatgtcgaagaagacttcactcacgtcggtgccatggacgcccgcggcttcctgatcggttcgatcatcgcctaccatctgaacaaaccgctgatcctgttccgcaagcaaggcaagctgccggccgatgtgcttgccgagggttaccagaccgaatacggcgaagccttcttggaagtgcatgccgacagcctgtgcgaaggcgattcggtgctgatgttcgatgacctgatcgccaccggcggtaccttgatcgccgcagccaacctggtgcgccgcatgggggcaaaagtctacgaggccgctgccatcatcgacctgcctgagctgggcggttcgcaacgcctgcgcgacatggacattccaaccttctgcctgacgcagttctcgttgagcgagcggtaaatcactccgcccttgagtagtcaggcccgacgctatcgcgagcaagctcgctcctacagtcgctgcattcccctgtaggagcgagcttgctcgcgaagcatagccctacagccccatctgcttgctgatgatttcgtttatcacttcccgggtgccgccgccgatggacaggatgcggttgtcgcgatacagccgctccaccaggctttcgcgcatgtaacccagcccgccgagaatctgcacggcatcgtgggtgatgcggtcggcggtatcggtggcgaagttcttggccatggaaatctccttgatcacgctctgccccgccgccatcttcgccgcctggcgataagtgaattcgcgggacacttccagcgcggtcgccatctccgccaggcgatgcttgatcacctggaacttgccgatgggcttgccgaaggcctcgcgctcccgggcccacttcaggctctcttccagcgccagctgcgcggtcatgttggccatcaaggccagcgccaggcgctcgctctggaagttgcccatgatgcaggcgaagcccaggttctcgacgccaatcaagtggctggccggcacccggcaatcgtcgaaaaacaactcggcggtatccgacgcccaccagcccatcttcttcagttgccggccgacggtgaatcccggcgtgcccttatcgatcagcagcaggctgatgccgccgaaaccgggctcgccggtacgcaccgacacggtgtagaaatcggcgcgcacgccactggtgataaaggtcttgctgccactgacgcgatagaagtcgccgtcacgcagcgcccgggtctgcagattggccacgtccgaaccgccgccgggctcggtgaccgccagggcgctgatcttctcccccgccaatacctgcggcaccacccgctcgcgaacctcggggcgcgcccatttgacgatcggcggcaaaccgatgtccagcgagcccaggcccgccaccaggccgccggagccacagcgcatcagctcctcgctggcggcaatcttggcgaacaggtcgccctcgtggctgccacccagggcttccggatagccgataccgaggatgccggccgcgccagccttgaggtacagctcgcgagggaagccttgcgcctcctcccattgatcgatgtccgggagaatttcccgctcgacgaaacgtcgaacgctgtcgcggaccaactgatggctagggtcgaagtattcctggcaggcagacatcggcaagctcctctgaaggttgaggaaacttacctagcgcttgcttggttttcaagaaggaccgcacgaaccacctgcaggagccagcttgctggcgatgcaggcgacgcggcgcgccaggtcgggtggccatcgcgagcaagctcgctcctacagtagtttttgctcgcagccgaaacacttacagcgcgatcggcttgcgcccggcaaacgagtgcgccagggtgccgccgtccaccagttccagctcgccgcccaggggcacgccatgggcgatacgcgaggtgatcaggcctttgttggtcaacagctgagcgatgtaatgggcggttgcctcgccttccaccgtcgggttggtggccagaatcacctcggtgaaactgccttgctcttcgattcgcgccagcagctgggggatgccgatggcttccgggcccaggccgtcgagcggcgacaggtggcccttgagcacgaagtagcgaccgcggtaaccggtctgctccaccgcgtagacatccatcggcccctcgaccacgcacagcagcgtgtcgtcgcgccgcggatcggcgcattgcgggcacaggtcgtcctcggtcagggtgcggcacaggcggcagtggccgacgccctccatggcctggctcagcgcctgggccaatcgcgtaccgccgctgcggtcgcgctccagcagctgcaaggccatgcgctgggcggttttctgacccacgcccggcaaagtgcgcagggcgtcgatcagttggcgaatcagggggctgaagctcatgggtaaaggtccgacaaaacgacgagacgcggtttatacccgcgcctccgattagcgtcaaatgctcagtccggggcgacccgcaccaccagcttgccgaagttgcgcccttccagcagcccgatgaaggcttgcggcgcgtgctccaggccgtctaccacatcttccttgaacttgaccttgccctgcagcacccagggcgccatggcgctgacaaactccggctgccgatcgccgtagtcgtcgaacacgataaacccctggatgcgcacgcgcttggtcaacagctggcgctgcaacagtggcaggcggtcaggtcctggcggcaactcctgagcgttgtactgagcgatcagcccgcacagcggaatccgcgccttggggttgagcaacggcagcaccgcatcgaacaccttgccaccgacgttttcaaagtagatgtccacgccctcggagcaggcctgcgccagttcgtcggcaaagtccgggctgtggtggtcgatacaggcatcgaaccccagctcctcgaccacatagcggcacttgtcggcaccgcccgccacaccgatcacccgcagccccttgatcttggccacctgccccaccaccgaacccacggcgcccgacgccgcggccaccaccagggtttccccggccttgggctggccgatatccatcaggcccatgtaggcggtcatgcccggcatacccagcacgcccagggccatcgaagggctgggcaaacccgccggcaccggtatcaggttacgcccgtcgcaaatgctgtggctttgccacccggtggcccccaccaccaggtcgccctcctggaatttcggattcagcgagcgctcgacccggctcaccgcgccgccggtcatcacttcgttgatttgcaccggggcagcgtaggacggcgcatcactcatgcgcccgcgcatataagggtccagcgacaggtaaagggtcttgagcagcacctggccatccgccaggtccggtagcgctacccgctccaggcggaagttttccggcacgggcgcgccctggggccgggaggccagaacaatgcgctggttgagggtcaatgcttgcgacatcagagcaactccttatcgagaattgaatcgggccatacagagtgcagaccatcgtactgcgatcggcgttcgatgtttctcatcccgtagccgctgttgcaggctgcgatcgattgcacggcaaccgcaatcatccagccagaccccatcgcctgaatgacgaccgctgcgcgctcgatcgcagcctgcggcagcggctacaggcgccacaaacaaaaatgccaggcgcgatgcctggcatttcaagtccgaccgatgcgcgggcgcgaatcagaacggcagtttcatacccggtggcagttgcatgccagcggtcacgccggacatcttgtcctggctgttggcttcgatcttgcgcacggcgtcgttgacggcggcggcgaacagatcttccagcacttcgcggtcatcttcactgacgccttccagcaggcttgggtcgatgctcacgcgcttgatgtcgtgacgaccggtcatgaccacggtgaccatatcgccacccgccttgccggtgacttcggcgttggccagctcttcctgcatcttggccattttttcctgcatctgctgcgcctgcttcatcaggccggccatgccacctttcatcatgggaatcacctcaaagtacttggataaaaacagcacccggcctcaaggcccggcgcccttcagttattaaccctggctgaccagggcctcgacaggttcaatagtatcgtgacggaccaccgcgccgaactcccgcaccatctgctggatgaacggatcgccgtggatcgactcctcggcctcgcgctggcgattggcccggcggcgtgacgcggcctgggccggggtctcctgctcgggcttgatcagctcgatgctcaccgtcagcgtgcgctggtggtactggttcagggcatcgttcaggcgccgctgctgggtggcgttgaacagggcgctgtgggccgggtccaggtgcagcaaccagttatcgccctcggcggcgatcaaggtgcagttggcggcgatgctcgccgtcatcccggaaatcggcagcttcgggaacagctccagccactccagcgccaggccggtggccggctgggcggctggcaacggctcgggttccggctcgggatcggcggcgtgctcgctggccagttcgtccaggtagctgtaggccgaatccatgtctggctcgatgtagtcttcgtccagcggcggctcgtcgtccaggtcgatccccggtgtcgcggcatcgacctcggcaacgctgggctccggcaccggggcgctgacccattccggcgcatccggcaccacgctgtccggggtctgggtcggcatcggagtcagctcaggctgctccgcggcggtctccagcacgggctcgacggccggttgctgcgcgacgaccggttcgaccgggtcgttccacggcaggtcgaccacctcttcggcgacgacaggcgctgcctctggcggcgtctcgaccaccggttgcggtgcaggcgccaccggcgctacaggagcctgtgcgggtactgcgacaggggcaaccgctggagcggcctcgaccaccggcgccgcaaccggagcggcggcaacacttaccggcgcagcaacagctgcgccagccactgattgggcggaatcaactgtggcctggctgatccccactggctttagcggctgtctcggcgcgtctgccgagtccgctggccggaaggccagcatccgcagcaggaccatctcgaaaccaccgcgcgggtccggcgccagcggcaggtcgcgccggccgatcaggcccatctggtaatagaactgcacatcttcggccggcaacgcctgggccagggccagcacccggtcgcggtcgccatgcccgttgtcgacaccgtccggcaaggcctgggcaatggccacgcggtgcaggacattgagaatctccgacagcacgccgttccagtccggaccctgttcggccaggtggcgcacggcctcgagcaaggccttggcatcgccgtcgatcagcgcatgcaggacgtcgtagacctggccgtgatcgagggtgccgagcatcgcccgcacatcggcggccatgaccttgccttcgccgaaggcgatggcctggtcggtgaggctcatggcatcgcgcatcgaaccgtcggcggcgcggcccaacagccacagcgcgtcgtcttcgaacggcacgttctcgacgcccagcacgtgagtcaggtgctcgaccactcgctccggggtcatgttcttcagggagaactgcaggcagcgcgaaagaatcgttgccggaagtttctgcgggtcggtggtcgccagaatgaatttgacgtagggcggcggctcttccagggtcttcaacaaggcgttgaacgagtggctggacagcatgtgcacttcgtcgatcaggtagaccttgaagcgcccgcggctcggggcgtactgcacgttgtccagcagctcgcgcgtgtcctcgaccttggtccggctcgcggcgtcgatctcgatcaggtcgacgaaacgcccttcgtcgatttcgcggcataccgagcaggtgccgcagggcgtggaggtaatgcctgtttcacagttcaggcatttggcaatgatccgcgcgatggtggtcttgcccaccccgcgggtgccggtaaacagataggcatggtgcagccgctgactgtccaaggcattgatcagagccttgagcacatgggtctggccgaccatttcgcggaacgagcgcggacgccatttacgtgcaagaacctgataactcatcgaaaaccgtcgcaactgggaagcggaagcccgtaatgctagcggagcaagggcgaaattgcatccggtgcgctcgtctaatctggctaagctgctttttgtcgggcttgtcagcggccttttcctgcgtggagactctatgcgtttagccttgggcgcctttctgctggttgccatgaatggttttgccgcagaaccggccctgcgcttctcgatccccgacagctgggccatgcccgtggtacagatcgaacgtggccggcccacccagggcatcctccacgacctgatggccagcctcgccacccaggtcggcaacccggccgaattccatgtcctggcccgggcccgcgtgcaggcagccatggaccacaaggaaatcgatgtccgctgctatatcgcccaaccctggctgcccaacccgtccggcgattacatctggagcatcccgctgttcgtccagcgcgacctgctggtcagccacgagcgccccccgctcccggtcattcccgggaacctgccgatgcagcccatcggcaccgtcctcagctacacctacccttccctgcaacccttgttcgacagccgccagttgatccgtgacgacgcgcgcaaccaggaacaagtgctgcaaaagctctgggccggccgctaccgctacgcggtgagcaaccaatggacgctggactggttcaaccagaccctgccacccgaccagcagttgcacggcgtggccgtcctccaggaacaggcggtcggctgcgtcatccgcaacgatccggcgctaccggtgcaacgagtgctgcgcaccttgttgcgcatgaagatgtcaggagagatcgacgacatcatcggtttgtacaccggccacaggccgaccgagagcgccccgcaaagctacggggcgccgtagctgtcagccggcttcgtcctgcggacaccattccagcggcggcaggaaggtcgccacccagcccggcacctcgctggccggcatgggcggggcgatgaaatagccttgcgccacgtcgcagcccagcgacatcagcaactcgccgtgctccatggtttccaggccttcggctaccacctgccgatcaaacgcccgggccaggccgatcagggcctgggtcagcgccaggtcgcccttgtcgtgcagcatgtcgcgcacgaacatgcggtcgatcttgatggtctgggtgcgcaagcgcttgaggtaactcagcgacgaatgcccggtgccgaaatcccccagggagaattgcacgcccagcgcctggcaggcctcgaggcaagcgctgacgtgctggagattctccaccgccaccgcctcgacgatttccaggtccagcaactgcggggcaatctgcggatggcgctcgagcaccgccttgagccggtcgacgaaatccccccgctggaaatgccgcgcggcgatattgacgctgaccggccaacgctgtccggccaactgccattgccgcaactgggccatgacctgctccatcacccactcgccgatatcgacgatcaggtcggtctcctccaccagcggcaggaactcccgaggcgcaaccatgccccgctgcggatgctgccaacgcagcaacgcctcgaaacccaccacctcgccgctgcgcatattgaccttgggttgaaagtgcaggcacagctcgccagccgccagcgcctgccggacccgctccactgtctggtgggtggccttgacctcgcggtcccgcgacacgtcgaacaagtggaagcgattgcgcccgctctgcttggccacgtacatcgcctggtcggcatgccgcagcaaggtgtcggcatcgtcgttatcggcgggaaacagcgtgacgccgatgctggcgcagacgttgatctccttgtcctggatcagataaggcgtggcgatcccccccagcacccggtgcagcgccgcccgcaactcgcgaatgtcgcgcacatggcgcaggatcagcacgaactcgtccccggccagccgcgccaccacgtcttcgccgcgaatgatcgagcgcaggcgcgccgctacctccaccaataacaggtcgccactggcatgcccgtagccatcgttgaccgccttgaagccgtcgagatcgagcatgcacaccgccagcgcaatgttctccttgcgcgagtagtccagcgcctggttgagcaggtcggacagaaaggaacggttgggcaaaccggtcagcacatcgtgcccgacccgccattgcagcgagtgcaacaagcgccgtttttcgctgatatcgaaacggatcgccacataacgctggacccgaccagtggcctcatcgagcaagggcacgatggtgctgtcgacccaatacaaggtcccatccttggcccggttgcagatctcgcccttccagacctggcccagggcaatggtgcgccacatgctgctgaaaaattcgggagggtgcaggccggagccgaggatccggtgattggcacccagcagctcttcacggctgtagccggaaatcgaacagaactggtcgttgacgtaagtgatccggccggtcaggtcggtctcggaaaaaatggcggctgcatccacggccctgcggtatttctcatccatgagtctggctcactgtcgctagcggttgaaccgctcgaccaaggcacgaggcccggaagagatgtttgggcgttcatcctcactcacttcgcaaacccaggcaggcttaggctgctgctccgaaggtatctgctgaacagaggtgaccggcacattcagacgcacgttaaaactccatagacagcattcgacaatgccagcccagacaagccggcaagaggccgaccgagaaaaatggcgcaccgtctcgccccacctgacacaattgcaaccgtacagcgacccgcaccgtcattgatcttcgaatcgacgaagatcaactaaaatcagtcagggatcagccgaatttggcgggtgggacactggcaatcatcagcgagacgttcgcgcctgcgccataccctcgattctggtgaacaaggaaaatgcaatgagttcttgtttcatcagttcatcttctgaaactagatcaccaaatgcctgtccgaagcgtcgattctacgaattgcatcacattttgcaaggcaaggtgatgaatcatggcgttgcctaatgcaaagatttatcgttaagttcttgattctaaatgggaattgagcgatgcaaatttcaagtttgggtccagccatcaggcgttaccgcaaggtagcggggcttactcaggctgaactaggcgaaaaaaccggttttgaccctaaaaccatcagccgcttcgaaaccggcacctacacccccagtgtggaagccctgttcctgctggccgatgtactcggggtgaagctgaaagcctttttcgcagatctgggcgacgaagacgaacagcgggcgtatctgttcggtgtcattcacaaagccaccccgaaggacctgggaaagctgatagcagcggtagacctggccttgtccaagccttagagccgagcaacacgcagaggaggcagccctatcgaagccgatagcctgcctcctcttcatttcccccagatgactcctgacaggaactgacagcggcgcctcttaagctggcgtgcgcagcccaacctctccaggagtccagatgatcgctaccagcacttaccttctgctttacgtcgacagccccgccaccagcgccaacttttacagccgcctgctggacaggccaccggtcgagctgtcgccgacctttgccctgttcattcttgattcggggctcaagctcggcctctggtccagacaggatgtcgaaccagccacccaagtcaccggcggtggcggcgaactggccctggccgtggccgataagcacaccgtcgaccggctgcacggccaatgggccgaatccggcgtgaacatcgcccaggccccgaccaccctggacttcggctacaccttcgtcgccctggacccggacgggcatcggctcagagtgttttgcctcaccccggagtgaacaggagccgtgccgatagagcccggcagcacagagcggcgctgcgcccagcgcccctccaactgcatcgccatcacactgccgaggacgatcgccgcgcccacgatcaccgcgccatgcacccgctcatgcaggaccagcgccgccagcagcatggcgatcggcggtatcaggtacatggcaatggatgcccggctgacttcgacccgcgccagcacataggcccacgccaggtaagccagcgcactgggaaacagccccagcaacaacaccgccaggttcacccgccacggcgcctggaccaccgcgaccgccagccccggccaatacaggctcaacagcaaagtgccagcccagaccatgtagcacacggtggtcagcaggtcgtaacgccccgaatagcgccgctgcaaaacgaagtacaagccccaggagaaggccgccagcagcaccagcaatccccggggctcgatcgacgccacgccctggtcgccccagaccaccacgaccgcccccagcaaccccagcccgacacacccccagcgccaaccgctgaccggctccctcaaccagaaaaacgcaatcagggtgctgaagatcggcgccgactgcgccagcacactggatgcccccgcgctcaacccctgctggccatagttgaggctgacgtgatgcaaggcgatggcgaaaaagcccagcaccagcaaccagggcagatcgcgccagcgcggcagggagattcttttcaccagggcgatgccccccatgaacagcgaggcaatcagaaagcgcagcaacgccagatggcctggttcgtagccttccagcccgatgtggatacccaccggggagtaggcccaacacagaatgaccgcagcggtcgccaggaccagcttcaacgcaggagagatgttcaagacacaggcactcggcagcacaaggaagaccttcagtctcccgcccgccacaactcaccacaattaacggatactgagaccagacctcactggaaatgagcaatggaactgagccaactgaaaatggtgaaagcggtcgcccgcaccggcagcattgcccgagcggccgaacaactgcattgcgtgccctccaacatcaccaaccgcctcaagcaactggaaggcgagctgggcacctgcctgtttatccgcgccggccgtgggctgaaaatcagtccggacggggaaatctttctcggctacagcgagcgcatcctggccctggtggatgaggccaaacgggcggtcgaccgcaaggccgaacccagcggcatcctgcgcatcggcgccatcgaatcctgcgctggcgggcgcttgccgccactgctggcagaattccatcagcgctttccacaagtcactctggagctggtaaccggcacctggtcgcagctgttcgaggaactgcaacatcaccggatcgatggcgcactggtcgcggtcgacaccccccacccgaagctggaacgcaccgccctgtacagcgagcccctggtgctggttaccagcgccgacgccgcgcccgtgctgaacccgcgagatctgcaagaccagaccctgttcatgtggcccggcggctgcccttaccgccgcgccctggagcactggctgaacgcccatgacgtgaccgcgaccatcatcggctacgcgagctggggcaccattatcgactgcgtcagcgccggcgccggcatgaccctggccccggaaggcgtgctcgaccgctacaccctgtccgcaggcctggcgcgccaccgcttcgccgacctgcagccgatcgacattcgttttgtctggaacaaggaaatacaacgccacaccgcacgggacgcgtttgcgcagttgttgcaggaacgattggggaaatgaaacgagcgaccggcgagaggccagatcaggataaagacagaggggagaatttagaatattcgtcgaggaccgacagagggcgttatggaggcaaccccaccagccacaccccggcacacaatgtcaccgctgcggctgctcccttccaggcctgaccgggttcacggctgatcgttgcgaggggaccaatggggtcaccataacgacgctcacctgacggcgagccgcgccattgtacctatctgcggcgaagttacaaccgctctgtaaagattaaaaaatcttaacggcttcaagtacttggatcattaccccgctcgcttgtcgattcctgtagccgctgccgcaggctgcgctcgactgcgaagccgtcgccaaccatttgtcgagcagcaacgaaacaccctgttgtccgccattgcggccgctgcgcgaccgatcgcagcctgcggcagcggctacagggaccgcgcatgagcgagatggcagttttgcggcgagccggcagtcgatttttcgctttgttttgtaaggggtttcctagaaactctggaacgcctttgggcgggttgtacccctgaatttgatcgggcagtctgcgtgggtcgttgcagtttcaacgacccggatgtggaagtctggagctaaggacgtacaaccttctcaacaagcacgggtgcctcatggcactggtgaacttgttctatggcggctgtgcgtggggcaccttcgggtgcgccggattcctttagctccggtcttccacacctacgcacggctgccacccctcatgtggaagtgagatttggcagttccttaaatgctaaaggaatcgcacacatgaaaaagctcgtccccgacccacccttcaccaccccgcgccgattacgcgaccctgaactggatgcagccaatgcctccctgctcctgtcgctcaacgaccagaaacaaccgctgctggcgcaactgaaagaaacccgcagccagcccttcggcctgcaggacgcccaacaacggccgctgttcgcggtgcaggccggggtgaatgccgaagaagccttgatgcatgtctcgctactgctcaaatgcgccgaagaagtctcggatgaaatcaccgaacagggcagcggcatcgaacgcgggctgatctggtccatggtgcattccgtggagatggctcgcgcggtggtcgatgccttgctcgatggcgtgcgtaccagccgctgatcgcgatccaggggcttgcttgcgatgcaggcggcgcggtgtggaagcagaccgtggggatgccatcgcgagcaagcttcgctcccacagaagcggtggtgggttcaggtttgttcgagtgctgcgtcggccttgccgccggcctgctggatcaccaggtggatgaagtgcagcttggcgatcaccgccggcggcaggatgaagggatagaaatccggctgacccatgctgcgcgacagttcgttgagcatgccggccagttcgatccaggcgttgacaaaagagaggaacgccgggccgccagggtgctgcgggtcatacagggtatccagcgggaacggctggtagtcgaagtccatttcccgggcgctcatgccgaagcccagcgcggtatcgaccgcgtccatcatgtgcaggtaatgggcccaggtttccgcccagtcctcccagggatgcatggtggcgtaggcgctgacataggtctgcgaccaatcgttcggcgcaccctgctggtaatgccggtccagggcttcggcgtagcttgcgcgttcgtcgccgaacagcgcgcgacagggttccagccaatggctgcctgcgatcaggcgatcccagtagtaatgccccacctcatgccggaagtggccgagcaaggtgcgatagggttcgcgcatctgtacccgcacctgctcgcgatacgcatcgtcggcctccttgatgtcgagggtgatcaggccgttggcgtggccggtcatgggcgccctgccctgcagatcgacaccgagaaaatcgaaagccaggccggcctcttcatcctcggctttggcgatcagcggcaagcccaggctcaccagttgcgccaccaggcggcgcttggcgatttccaccatgcgccagcgttcggggttttctggtacgccaagatcgggaatggtccggttcagcctgcacgccacacacagggtagcggcgccatgcgcaggcagcagccagttgcaggccgccggggtatcgaggttggcgcaacgccggaacagcccggcttgcggatcgacgtccagccgccaggtatcggcctccggtcctggctgcagcgacgacaggcgactctgctcgggctgataacccagggccgccgaacaggccaggcactgactgttgcgaaagaacagcgattgcccacagcgacaccgccagaccttgctgttgcggctgtcttcacggataaagggcgcggcgatacgggaactgagctgttcgaagaagcggtacatggcgatctctccctgggcgtgccaagactagatcatgggaacaagacgattgttccttcgccttgatggccatccgcttttctgtaggagcgagcttgctcgcgaagcgatttccatgtcgcatcgtgcgcaagcctggagacttttcgcgagcaagctcgctcctacagggcaatgcgattccatgtagccgctgccgaaagctgcgatcgaccgcatggcgggcgttgcgccgccctcggcagcggctacgggatcagaccgggataccgtgctggccgaggaaggccacgaaggcttcttcgtccagcaccttgaggcccagctcgttggccttggccagcttggagccggcaccggggccggccaccacgcagtgggtcttggccgaaacggaaccggcgaccttggcgcccaggctttccagcttgtccttggccacgtcgcggctcatcagctccagcgagccggtgagcacccaggtctggccggccagcggcagcccttccaccactttcttctcgctctgccagtgcatgccgaaggcttgcagctgcgcctcgatggccagtgcccgctcggcgttttccgcgatgtcgaagaactcgcgcacggccttggcctgcttctccggcagggtctggcgcatgtccagccagtccgccttgaccacgccgtcgagggtcgcgaacttgtccgccaacttctgcgccgcacccggccccaccgatggaatgttcagcttgtcgagcatgccgcccagggtggtgctggcagcgaactcggcacccaggtcgccctgatcctgcaactgcagcccgcactgctgcggatcgagcagggcaccgattacctgctggttatggctgtcctcgaagaagctgtgaatctcgtgagccacttccaggccgatatccggcagataggtcagcacttccggcaaggcctgctgcacgcgctccagcgaggccagggagcgcgccaggaccttggccgtctcctcgcccacatcgggaatgcccagggcgtagatgaaacgcgccagacccggcttcttgctgtcttcgatggccttgagcagcttgttgctggagacttcggcgaagccttccagatcgatgatctgctcgtacttgagtttgtagagatcggccggcgaaccaatgagcttttcgtccaccagctgctcgatggtcttgtcgcccagcccttcgatatccatcgcccgacgggaaacgaagtggatgatcgcctgcttgagctgcgcgccacaggccaggcgaccgacgcagcggtacaccgcaccttcgctgatggtttccttgcccttgctgcgcttgatcagttgcgtgcgttcgacatgggagccgcacaccgggcaggtctgcgggatatgcaccttgcgcgcattttccggacgacgctcggcgaccacctgcaccacttgcggaatcacatcgcccgcccggcggatgatcacggtgtcgccgatcatcaggcccaggcgcgccacttcgtccatgttgtgcagggtcgcgttggagacggtgacacccgccaccttgaccggtttcagacgggccaccggggtcaccgcgccggtgcggccaacctggaattccacgtccagcagctcggtcagctcttccatcgccgggaatttatgagcgatcgcccagcgcggctcgcgagcccggaagcccagctcgcgctgcgaggcaatgctgttgaccttgaacaccacaccgtcgatttcataaggcaagccattacggcgctcgccgatatcgcggtagtaatccaggcattcgtcgatacccttggccagtttcagctcgcgactgacgggcatgccccagcgcttgagctgctccagattgccgatatgggtgtcggcgatatccgcagtgacctggccgatcccgtagcagcagaattccagcgggcggctggcggtgatcttcgagtccagctggcgcaagctgccggccgcggcgttccgcgggttggcgaaggtcttgccgccaacttccagctgcgcggcattgagccgctcgaaaccggccttggacatgtacacctcgccgcgcacctccagggtcgccggccagccactgccgtgcagcttcagggggatgttgcgcacggtgcgcacgttgacgctgatgtcttcgccggtggtgccgtcgccgcgggtcgcgccgcgcaccagcacgccgtccagatacagcaggctgaccgccaggccatcgagcttcggctcgcagctgtattccaccgccgccccgccaccgaacagatcgcccgccggcaggtcgagaccctcggtcacccggcgatcgaactcgcgcatatcggtttcttcgaaggcgttgcccaggctgagcatggggatttcgtggcgcacctgagtaaaggccgagagcgccgcgctgccgacgcgctgggtgggcgagtcgctgctgaccagctccgggtgttcggcttccagtgccttgagctcatggaacaggcgatcgtattcaacgtccggaatgctcggctcgtcgagtacgtggtagcgatagttgtgctgatccagctcagcgcgcagctcaagaatgcgggtttcggcggaggtcatggtgttctctcaaaaagcaaaagagcagcctaggctgctcaatatttgtctgggtgggcccttcggccctatcgcgagcccgctccggcaggccaagggttatgccggagcggctggctcgcgaagcgctcagcgcttctgggtcagggcgcgacgttcgaattcgacgatgcgctgacggtagtgctcgatggtctgggcggtcagcacgctgcgctggtcatccttcagctcgccattcagttcctgggacagcttgcgcgccgcggccaccatcacgtcgaaagcctgtttcggatgacgcgggcctggcaggccgaggaagaagctcaccgccggggtgctgaagtggtcgatgtcatccaggtcgaatacgcccggcttgaccgcgttggccatggagaacagcacttcgccgttgccggccatgctttcgtgacggtggaaaatatccatctcgccaaaacgcaggccgctttccaggatgttctgcaacagcgccgggcccttgaagccgccggagtcacggcagatcacgctgatcaccagcacttcttcggcttgcggctggtccttgtcggcgtaaccggaagccttggtttcatccgggaagtcatcgtcgcggctgctgaagctcgggccgccgtccagatccaggttgaggttcaggtcgccctgttgtggctcgctggcacgcttgccacgcttggaaccggattcgcgcggttcgcgcgccggcgcgctcatcgacggcaggtcgtgctcgtcgagttgcggttccttatgggtatccagcacgcggggcgggcccagcagttcggcactgctgtcgtcgtccggcaggttggacaggctacgatccaggcggaatttcaactttcctttgccgccgcgcatacggcgccagccatcaaaaagaataccggcaatgacaatgatgccgatgacgatcagccactcgcgcagaccgatttccatgtaatcccgtgcctctatgaaaaatgctgaaaaataagaggtttagcaaactgcaaaccgctttaaaacgtggcgccaactctatgttctgactggccttttgcccacgtataggaaaaattgacattaaactagcacgaccaaagacaactttacaccgtctgtcgcaacggcttcattcaatatgtcgatcagccagtactcggcacaggtaaaaacctcttacttgtcacttacataccggctttggtcgcccggatatcaggcgtccaccatcgccatcgcctcctcgacatccactgctaccaggcgcgaacagccgggttcgtgcatcgtcacgcccatcaattgatcggccatttccatggcgatcttgttgtgggtgatatagatgaactgcaccgtctgcgacatctctttaaccagccttgcgtagcgtccaacgttagcgtcatccagcggggcgtcaacttcgtcgagcatgcagaacggcgccgggttcaacttgaagatggcaaataccagcgccagggccgtcaatgctttctcaccaccggacaacaaatgaatggtgctgttcttcttccctggcggacgcgccatgatcgttacccctgtatcgagtagatcttcgcccgtcagttccaaataagcgctgccgccaccgaaaacttttggaaagagcgcctgtaaaccgccgttaatctgatcaaaggtatccttgaaacgattacgggtttccttgtcgatcttgcgaatcacgttttccagggtttccagggcttccaccagatcggcgtcctgggcgtccagataacgtttgcgttcggactgctgctggtactcatcgatggccgcgaggttgatcgcccccaggcgctggatacgcgcggcaatccgctcgagctcttcctcggcctctttctcgctggcctgctcggtcagcgtggcgagcacgccctgcaagtcgtagccgtcttccagcaactggtcctgcaaggtcttgcgacgcacgctcagggcctgccattccatgcgctgctgttcgagctggccacggatcaactgcgattgctgctcggcctgggtccgacgtttttccgcgtcgcgcaattcgcggtcggcatcttccatggcgatctgcgcgctcttgagctcgacgtcgacggtcatgcgtttttccagcaattcctcgagtttcaggcgcagctcttccaacggcgcggcgccctcctccaggttcagactgagctgttcacgcttctccgtcagacgctccgattgcagctccaagcgctccagggcctggcgggtggaatcgtgctgggccttgagcgaccccaggcgcaccgccaactgatgagcgtgatccttgtgctggcgcgcctcctggcgcacccgatccaggcgttcgcgcaaactgtcgcgctgggccagcagcaattcgcgctgctcggtgtccagggccatgctgtcgagggcttcctgcaactgcagacgggcttcgcccacttgctcgtgttccaccgcgcgctgctcgcccagctccgccacttcttcatccaggcgggtacggcgcagggccagttgttcggccttggccttgccggcagaaagcctggctttcaattcaccctgctgtcgggcttcgtcctgcaacagacggcgcaggtgttcgcgaccgttctcttgctggcgctgttgcgcacgcaggttctgcaaccgggtttccaggtcttccacgctggcttcgcgctcgtcgcgctccaggctcagttgttcgatttcctggttgcgcgcgagcatgccgctttccgcttcgctggcgcggcgcacccgcagaaaatgccggccgacccagaacccgtcacggctgatcaggctctcgccggccgccagttggccacgcaacgccaaggcctgctcaaggctttccaccggcttgacctggcccagccagggcgccagatcgacctgggcatcgaccttgtccagcaggctgccaggcatccgcgcgccctcgcccgccagctggagcaggcgcaggtcgccctgctcgaagccagccaggtcgaagccggcaaaatcgtcgaccagtaccgcttgcaggtcggcgccaagcacagtttccaccgccagctcccaaccggcctcgaccttcaggccttcggccagccgcggacgctcggccaactgttgctcctgcagccactgcgcggcgccggtccccggattgagcgctgcctgctgcaaagcctccagcgaggccaggcgcccattgaggcgctgtagttcgccctgggcctgctgctgggcctgggtcgcctgatgcagctcctggcgtagttgctccaagcgctcgacttgagcgtcttcgctggcctgcaggtcttccagggtcgcctcgctggccgcgagttgttcattgagttcgaggatcgccgcgtcttccggatcggcggcgagcaacacgcgctcctccaccaggcgccgctggcgctcgcccaggcgctccatgctgccttcgagctgctggatacgcgactgctgcacctcggcctggcgtcgcggttcagcggacttgaggttgaaaccgtcccactgctcctgccagccgtgcatggtggtttcggcttcttccagggccgcggcggcctcttcggcggcggcgctggtgacttcctgctcgggctcgagcatttccaactcttcaccgagggtcgcgagcaaggtgcggtcgtggcccaggtgggattcggtctcctggcgtgcacgctcggcttcgcgcaagtcgtcctgcaactggcgcaaacgctgctggccgtgctggatgctctgttcgacccgggcgatgtcgccaccgaccgaatagaagcgcccctgcactagattgaagcgctcggacagctcatgatgaccgtcacgcaggcgttcgatggcggcatcggcattgcgttgctccgccaccagggcttcaaagccgacttcctggttgcagatgatcgattcgcgctggccgacctgctcgttaagctcctgccagcgcagtgccgacagctgtgccttgagctgacgctcctcgcctttgtattcctggtacttctcggccgcctgagcctggcggtgcaggcgttcgagctggcgttccagctcctcgcgcaggtcggtcaggcgcgccaggttttcgtgggtacggcggatgcggttctcggtttcccggcggcgctccttgtacttggaaatcccggcggcttcttcgatgaagttgcgcaggtcttccggcttggcttcgatcagcttggagatcatgccctgctcgatgatcgagtagctgcgtggccccaggccggtgccgaggaagatgtcggtaatgtcacgacggcggcacttggcgccgttgaggaaatagctgttctggctgtcgcgggtgaccttgcggcggatggagatttccgcgtaggccgcgtactcgccgaccagggtaccgtcggagttgtcgaagaccagctcgatgctggcctggctcaccggcttgcggctggtggaaccgttgaagatgacgtcggtcatcgactcgccgcgcaggttcttggccgagctctcgcccatgacccagcgcacggcgtcgatgatattcgacttgccgcaaccattgggcccgaccaccgccgccatgttactggggaagttcaccgtggtcgggtcgacgaaggacttgaagcccgccagcttgatgcacttgagccgcacgctcaggcaaccgtcaaggcggcgactaccaggtcgcaactgcgccgggcataggccgtcagcaccaggcggatcgtcggcaggtcacgggccagcacggcggccagcagttgctcgaacaggtcgaggaattcgctcatttccgccttgcgctgctccagggccaggaaataggcacggctcatcgccggctgcaggttctcgacggtttcctgcaggtacgggttgtcggcgaacgggtaggcggcgcgcatcacgttgaagctgtcttcgacgaaactgcggatgtcctggcgctcgtaggcggcgatcaatcgttgttggatctgcaggaacggcgccatgtcggcctgcagttcccagccgttggccaccgagttgcccagcaggatgtacagctcgctcatcagggtgcacaggctctgcaccttgtgcggggtgagttcggtcacatgggcgccacgacgcggcaggatggcgatcaggtgacggcgttcgaggatcagcagggcctcgcggaccgagccgcggctgacgttgagggccagcgtgaccttctgttcctgaatgcgctccccaggcttgagctcgccgcgaatgatgcgttcggcgaggtggtgagcgatttgctcggcgaggctgtccggcgccttgaacgtcatggttttccttcaaactcttagatcggtacaagcggcgcagtgtagcgcaattgctacctcatggcggagtgcccaagggcctgaatttggcacggaataagcaaaaggcactgcggcccgggagggtcaatactgtttgaaagcgcttgttgatcggcaaaaaacgatttcctgacccttaagtcagaaaatcattgaccgaaaagtcagacatgactaaattcggcccacgtcggttaccaacaataatgagtctgcgaggccttccgtgatccagtttttactcaaccaggaactccgtagcgagcacagcctggacccgaatctgaccgtgctcaattatctgcgcgagcatctgggcaagcccggcaccaaggaaggctgcgccagtggcgactgtggcgcctgcaccgtggtggtcggcgaattgcagaccgacgacacgggcacggagcatatccgttatcgcagcctcaacgcgtgcctgaccttcgtctcgtcgctgcacggcaaacaactgatcagcgtcgaagacctcaagcaccagggccagttgcacagcgtgcagaaagccatggtcgaatgccacggctcgcagtgcggcttctgtacgccgggcttcgtcatgtcgctgttcgccctgcagaagaactccgaacaacccgacgcgcacaaggcccacgaggccctggccggcaacctgtgccgctgcaccggctaccgtccgattctcgccgccgccgagcaggcctgctgcggcaagcagccggaccagttcgacgcccgcgaagccgagaccatcgcgcgcctgaaagctatcgcccccagcgacaccggcgagctgaacagtggcgacaaacgttgcctggtaccgctgaccgtatccgacctggccgacctgtatgacgcctacccgcaagcccggctgctggccggcggcaccgacctggcactggaagtcacgcagttccaccgcccgctgccggtgatgatctacgtcggcaacgtcgccgaaatgaaacgcatcgaacgcttcgacgaccgcctggaaatcggcgccgccaccgccctctccgactgctacgacgccctcaaggccgaatacccggacttcggcgaactgctgcagcgcttcgcctcgttgcagatccgcaaccagggcaccctgggcggcaacatcggcaacgcctcgcccatcggcgactcaccgcccttgctgatcgccctgggcgcgcagatcgtcctgtgcaagggcaacacccgccgcaccctggccctggaagactatttcatcgactaccgcgtcaccgcgcgccaggaaagcgagttcatcgagaagatcatcgtgccgcgggccagcgcccagcagctgtttcgcgcctacaaggtgtccaagcgcctggacgacgatatttccgcggtctgcgcggccttcaacctgcgtatcgagaacggcgtgatcgccgacgcccgcgtggccttcggtggcatggccgccaccccgaaacgcgccaagcactgtgaggccgcgctgctcggcgccccgtggagcgagaccaccgtcgaacgtgcctgcgccgccctgggcgaagacttcaccccgctttcggacttccgcgccagcaaggaataccgcctgctcagcgcccagaacctgctgcgcaaatactttatcgaactgcaaacaccgcacatcgagacccgggtgaccgcttatgtctaatcatcacaaagtcgagaagactcaagccgaactgagcgccctgtttcaacaggacctggccaccggcgtcggacgcagcgtcaagcacgacagcgccgccaagcatgtgtccggcgaggcggtgtacatcgatgaccggctggaattccccaaccagttgcatgtgtatgcgcgcctctcggaccgtgcccacgccaagatcctcagcatcgacaccgcgccctgccatgccttcgacggcgtgcgtatcgtcatcacccacaaggacatcccggggctgaaagacattggcccgctgctacccggcgacccgctgctggccatcgacgacgtgcagttcgtcggccagccggtgctggcggtggccgcccgcgacctggaaaccgcgcgccaggcggccatggccgcggtcatcgaatacgaggacctggagccggtcctggacgtggtcgaagccctgcgcaaacgccacttcgtcctcgacagccacacccaccagcgcggcgactcggccaaggccctggccagcgccgagcatcgcctgcagggcacgctgcacatcggcggccaggaacacttctacctggagacccagatttcctcggtgatgcccaccgaagacggcggcatgatcgtctactgctcgacccagaaccccaccgaggtgcagaagctggtggccgaggtgctggacgtgtcgatgaacaagatcgtggtcgacatgcgccgcatgggcggtggtttcggcggcaaggaaacccaggccgccagcccggcatgcctgtgcgcggtgatcgcgcacctcaccggccagccgaccaagatgcgcctgccgcgggtcgaagacatgctgatgaccggcaagcgccaccccttctatatcgagtacgacgttggtttcgacagcaccgggcgcctgcatggcatccagctggaactggccggcaactgcggttgctcgccagacctgtcggcctcgatcgtcgaccgggcaatgttccacgccgacaactcgtactacctgggcgacgccaccatcaacggccatcgctgcaagaccaacactgcgtcgaacaccgcctaccgtggcttcggcggcccgcaaggcatggtcgccatcgaggaagtgatggacgccatcgcccgccatctcgccctcgacccgctggccgtgcgcaaggccaactactacggcaagaccgaacgcaacgtcacccactactaccagaccgtcgagcacaacatgctcgaagagatgaccgccgaactggaagccagcagccagtacgccgagcgccgcgaagcgatccgtcgctacaacgccggcagcccgatcctgaaaaagggcctggcgctgaccccggtgaaattcggtatttccttcaccgccagtttcctcaaccaggccggcgcgctggtgcacgtctataccgacggcagcatccacctcaaccacggcggcacggaaatgggccagggcctgaacaccaaggtggcgcaggtggtggccgaggtgttccaggtagagatcgaccgggtgcagatcaccgcgaccaacactgacaaggtgcccaacacctcgccgaccgccgcctccagcggtgccgacctgaacggcaaggcggcgcagaacgcagcggaaatcatcaagaaacgcctggtggagtttgccgcccggcagtacaaggtcagcgaggaagatgtggaattccacaacggccatgtgcgggtccgcgaccagatcctgagcttcgaggaactgatccagcaggcctatttcgcccaggtctcgctgtccagcaccggcttctacaagaccccgaaaatctactacgaccgtgcccaggcccgtggccggccgttctactacttcgcctacggtgccgcctgcgccgaagtaatagtcgacaccctgactggcgagtacaagatgctgcgcaccgacatcctgcatgacgtcggcgcctcgctgaacccggccatcgacatcggccaggtggaaggcggctttatccagggcatgggctggctgaccatggaagagctggtgtggaacaacaagggcaaactagagacctgcggccccgccagttacaagattccagccgttgccgacatgcctttggatttgcgcgtgaagctggtggaaaaccgcaagaacccggaagacacggtgttccattccaaggccgtgggcgagccgccgttcatgctcggcatcgccgcctggtgcgcgatcaaggacgccgtggccagcctcggcgattaccggcaccagccgaagatcgacgcgccggccacgccggaacgggtgttgtggggctgcgagcagatgcgccagttgaaggtggcgaaggccgtggagaccaaggcggaactggcttccctgtaaatcccatcgcgagcaagctcgctcctacagatatcgcaccctcctgtaggagcgagcttgctcgcgatgacgacattgcagacgacaacgttgcaagaggtgaaacatgtacaattggatcagcgccctcgccgacctgcaaacccgcggcgaaccctgcgtgctggtgaccatcatcgaagagctggggtcgacgccacgcaatgccggctcgaaaatggtcatcagcaccacccagagcttcgacaccatcggcggcggtcacctggaatacaaggccatgcagatcgcccgcgagatgctcgccagcggcaaacaggacacccacctggagcgcttcagcctgggcgccagcctcggccagtgctgcggtggggtgacggtgttgctgttcgaacccatgggccaggtccaggcgcagatcgcggtcttcggcgccggccatgtcggccgcgcgctggtgccgctactggcgagcctgccgtgcaaggtgcgctggatcgactcgcgggaacaggaattccccgagcagatcccccagggcgtgcgcaagatcgtcagcgaagagcccgtcgatgaaatcgatgacttgcccgccggcagctattgcatcgtcatgacccacaatcaccagctcgacctggagctcaccgccgcgattctcaagcgcaacgactttgcctacttcggcctgatcggctcgaagaccaaacgggtgaagttcgaacaccgcctgcgcgagcgcggcttcgacagcggcgtgctgcaacgcatgcgctgcccgatggggctcggcgaagtcaaaggcaagttgcctgtggaaatcgccatctccatcgccggcgaaatcatcgccacctataacgccaatttcggccagcacagtgcccgcgccgaacccattgccaagctgctgccggcctcgcgccgcagccacgccactcattaaaaagccacgaaccgagactgcctcatgcctctgactcgcaaagcctaccgtgccgccatcctgcacagcatcgccgaccccgccgaggtcggcatcgaagcctcctacgagtatttcgaggatggcctgctggtagtcgacaacggccagatcagcgccctcggccacgccagcgaactgctcgccagcctgcccgccgatatcgagatcactcactaccaggatgcgctgatcaccccaggctttatcgacacccatatccacctgccgcagaccggcatggtcggtgcctatggcgagcagttgctggactggctcaacacctacaccttcccctgcgaaagccagttcgccgaccaggtccatgccgaggaagtggcggggattttcatcaaggaactgctgcgcaacggcaccaccaccgccctggtcttcggcagcgtgcatccgcaatcggtgaatgcctttttcgaagcggcgcagaagctcgacctgcgaatgatcgccggcaaggtgatgatggaccgcaacgccccggactacctgaccgacaccgccgaatccagctacctggaaagcaaggcgctgatcgagcgctggcatggcaagggccgcctgcactatgcagtgacgccgcgtttcgccccgaccagcaccccggaacaactgaccctcgccgggcaattgctcggcgaataccccgacctgtacatgcagacccacatcagcgagaacctgcaggaagtcgaatgggtcaaggagctgttccccgagcgcaagggctacctggacgtgtacgaccactaccagttgctgggcgagcgctcggtgttcgcccatggcgtgcacctgtgcgacgacgaatgcgcgcgcctggcgcagaccggctcggccgtggccttctgcccgacctcgaacctgttcctcggcagcggcctgttcaatctgccgatggccgagaagcacaagctgaatgtcggcctgggcaccgacgtcggcggcggcaccagcttctcgctgctgcagaccctgaacgaagcctacaaggtcatgcagttgcagggcgcgcgcctgagtccgttcaagtcgctgtacctggccaccctcggcggcgcacgcgcactgcgcctggaagagcggatcggcaccctgcagccaggcaccgacgccgacttcctggtgctcgactacaacgccacgccgctgctgagctatcgcctgaaacaatccaagagcatcgccgagacgctgttcgtgctgatgaccctgggcgatgaccgcaccgtggcgcagacctatgccgcgggcaatctggtgcaccagcgctaatcccggaaacgaaaaatcccccgcctcatgcgctgaggcgggggatttttttatctgctgtaaaccctgtaggagcgagcttgctcgcgaaaagatcgccaaggatgacgagctttggcagacaggtcgccgcttcgcggctatcgcgagcaagctcgctcctacagggagatggcgttacagcttggcgggagagcggcccggtttcttggtttgcagcaggtgcgagaacaccgcgtgcaggtcgtccgaggcgctttcttcgtcgaggttgagcttgctgtcgatgtgatccatgtgatgcatcatcagggtcaccgccagttccgcgtcgcgggcctcgatggcgtcgatcaactgggtgtgctcatcgtaggaacagtgcgaacgattgccgctttcgtactgagcgatgatcagcgaggtctgcgacaccaggctgcgctggaagctgatcagcggggcattcttcgccgcctcggcaagtttgaggtggaactcgcccgacaagcggataccggcaccgcgatcgccacgggaaaagctgtcgcgctcgtcgttgaccatctgccgcagctcggcaagctgttcggccgtggcgtgctgcaccgccagctcggtgatcgcccgctccaccagccggcgcgccatgaacacctggcgggcttcctcgacactcgggctggccacgaccgcgccgcgattgggccgcagcagcaccacgccttcatgggccaggcgcgacagcgcacgacgaatgatggtacggctgaccccgaaaatttcccccagcgcctcttcgctcaacttggtgccgggcgccaggcgctgttcgaggatggcctcgaagatatgcgcgtagacaatatcgtcctgggtcccgctgcgaccggccttgcctgctcgcggttgtttcttgaggggttgcaactgttcgttcatgggcactcgagtcgggagaactgcggcgaattgaccgtgactgtaatacggcacagcgggtcgctgacaagtatcgcgtaaaaacaatggcacattgtacacaacccatggggtccattcgcaataactgtatgggctacaggcgaccacaacgactgtacggccatttgccgccctggctgtattgcaatgaatagttacttttacgtttaggcttggcccctgctttcgtcacccaacgcccctgcgccgggctttcgggcgacagatatcttcatcagaacaaggaacagtgctccatgtccgacgcctccctcgcgccattacgccccctggccgatacctcgccctcggccgtagtcgccggcttcatcgccatgatgaccggctacaccagctccctggtgctgatgttccaggccggacaggccgccgggctgaccagcgggcaaatttcctcgtggatctgggccatctccatcggcatggccatatgcagcatcggcctgtccctgcgctaccgcaccccgatcaccgtcgcctggtcgacccccggcgccgcgctgctgatcaccagcctgtccggggtgagctacggcgaagccatcggcgcctatatcacctgcgcggtgctggtaaccatctgtggcctgaccggcagtttcgaacgcttggtcaagcgcatcccggcctccctcgccgcggcactgctggcgggcatcctgttcaagatcggcagcgagatcttcgtcgccgcacagcaccgcaccggcctggtgctgggcatgttcttcagctacctgctggtcaagcgcctgtcgccacgctacgcggtgctcgccgccctgctgaccggcaccgcattggccggggtgatgggcctgctggacttcagccaattccacctggaagtcgccacgccggtctggaccactccgcacttctccctggcggcgaccatcagcatcggcatcccgctgttcgtggtggccatgacctcgcagaacatgcccggggtcgccgtgctgcgcgccgacggctacaacgtcccggcctcgccactggtcaccaccaccggcatcgcctccctgctgctggcgccgttcggctcccacggcatcaacctggcggccatcagcgcggcgatctgcaccggcccccatgcccatgaggaccgcaacaagcgctacaccgcggcggtctggtgcgggattttctacggcatcgccggggtcttcggcgccacgctggcggcgctgttcgcggccctgcccaaggagctggtgctgtcgatcgccgcgctggcgctgttcggctcgatcatcaatggcctgagcatcgccatgagccaggtaaaggaacgcgaggcggcgctgatcacctttatggtgacggcctcgggcctgaccctgttctccgtcggctcggcgttctggggaatcgtggccggcgtgctgaccctggtgatcctgaactggaacaacgaataagcctgtagccgctgccgcaggctgcgatcgcgaccgaagggcgcgcaaggtctcacgatcgctgaagcccttcgggcttatcgcagcctgcggcagcggctacaatccgcccacgcgaaatcccgggaaacaggcccgaggcatataaaggttctgcgggggaaataaatagagaaggctgtacagcgacagccgtgagtcggcggcccggacgggccaccgactcagcacatcaggctaccggattgatcgagttttccgggtaccagacgtccagcagcgggctgacttcaacgctggtcagctcggtgcgggccttgagccaggcttcgaccttggcacgttgctcttcgctgaccgaaccgcgtttgctcaggcaaaccaggccgaagtcatcgccaccaacatagccgaggccgttggcttccatcgcttctttgaggaacgcgtcgaggaaagcgtcaatagcctcttcggccagatcttctttgaaatccaggttcagctcaaaacccagctcctgaaattcatctacgcacagttttttgcgcagacggcgggaacggttagtggccatggaacaatcctcataagtaataacgggcggcactttaccagtttaagcaaccgattgcctgactctatgagggccttggccggccattgggaaaaaaatagcggattagcccgccgcggcacggcacaagccgctataccttggggcataatgccgacactttcgtgaccactgagggaatttatcgtcatgccctcgtcttttctcccctcggctgtagggttttacttcacatgatcaaatctttgcgtccactttttcttgccggtcttcttctgcccctggccatttccgtttccgccgcccccgtcaacaccaccctttcgcccaaggttcaacaggccctcaaggccagcaaactgcaagacaacgccctgtcgctggtgatgatcccactcaacggcccgggcacggccaccgtttacaacgccgacgtgtcggtcaacccggcctcgaccatgaaactggttaccacctacgccgccctggaaatgctcggcccgacccaccagtggaaaaccgagttctacaccgacggcaccctgagtggcggcatcctcaatggcaacctgtacctcaagggcggcggcgatcccaagctgaacatggaaaaactctggttgctgatgcgcgacctgcgggccaacggcgtgcagcaagtgaccggcgacctggtgctggaccgcaacttcttcgtgcagccgcaactgccgcagttcaacgacgacggtaacgacgagaacaagccgttcctggtcaagcccgacgccctgctggtcaacctcaaggccctgcgcttcgtggcgcgcaacgattcgggcaaggtgctgatttccgtcgagccgccgattgccagcattcgcatcgacaatcaggtcaaggccatcggcggcaaacagtgcaccggcaacgtgcgctacaacccggtcccgcaggcggacggcggcgtcaccgtgaccgtcaacggccagttgggcgacggctgcagctcgcagacctacctgtcgctgctcgaccacgcgacctacaccgccggcgccgtacgcgccatctggaaggaactgggcggcagcatccagggcaaggaccgcctggccgccgtgccatccagcgccaaggtgctggcccgggccttctcgccggacctggcggagatcatccgcgacatcaacaaatacagtaacaacaccatggcccagcaactgttcctcagcctcggcgcgcaataccgcaccgaagccgatggcgacgatgccaaggcggcgcaacgggtggtgcgtcagtggctggcgaagaaaggcatcaccgcgccgcacctggtgatggagaacggttcgggcctgtcccgtgccgaacgggtcagcgcccgggaaatggcctccatgctgcaagcggcctggagaagcccgtactcggcggagttcatcagttcgatgccgatcgccggcatggacggcaccatgcgcaagcgcctgaagcgcaccgccatgtccggtgaagcccacgtgaagaccgggaccctgaacaccgtccgcgccatcgccggctacagccgcgacagcaacggcaacacctgggccgtggtagcgattctcaacgatccgaagccctggggcgcgtcctcggtgctcgatcaggtgctgctggatctgtaccgccagccgaaactggcagacaccgcttcgaccctgtaagccgtcactcgcaggtggcgcgagggcaacctcgcgtcacccccacttctgcgcccctgcctaccccatctctgcctcgacccggtcgcgcccagcctgcttggccgcatagaccccggaatccgcccgcagcaatagcccgtcggccccttcgtgttcccgccagctggcgatgccgaaactggccgtgacaatgcccacgccatcgatcggcgagctgcgcagcccgcgccacagctcctcggccaggacataggcctgctggccatcggtgtccgggcacagcaccatgaactcttcgccgcccagccggcaaaacacatccgtgcgccgcagacgaaggctgatgcgctcacagacaccgcgcagcaccatgtcgccgatggcatgcccgtactggtcgttgatccgcttgaagtggtcgatatccagcatgatcaccgccagattgcccaccccgcgctcgacccgcgccatttccgtctgcaggcgctcctggaaatagcggcggttgtggataccggtcagggagtcggtgaccgacagggcccgtaactcttcctcgacccgcttgaggtcggagatgtccgacagatagccatgccacagcaccccgccccccgcgagcttttccggggtcgcttcgccgcgtatccagcgcaggccgcgctgtggcaactgcacccgatattcctcgcgccaggggctgagtttcttcgccgaggtccagatcgagccgcgcacccgggccacatcgtccgggtgaatacgctcgaacaccgggttggcatcgcgctgcaactgctgtggatcgatctcgtagatatcgcggatgccgtcactgacgtagctgaagctggaatggccttcggcatctacctggaactgatagatggcgcccggtacatgggcgctgagtttcttcagcaggcgatcgcgggccgccagcgcctcgtggacccgcttgcgttcggtgatgtcgatacagatcgccaggtgcccgacccataagccgtgatcgtccaggaccggggtggccagcatgttcaccaccagatgactgccatcgcggcgcatcagggtccactcgcgggtttcctcgccccgttcttcggaaccgtccaccagcatcgcctggcacatcgggatctgccggccgtaacgctggctcagggcttgcgcgcgcgcattcagctccgcgggcaggtgcaggctttccagggtcaggtggcccaccacctcggcgctgctgtagccgagcatatgttcggcgccggcattgaaggtgctgatcacgccccgcaggtcggtggcgatgatcgccacctgggtcgccgcattgagcacgctgcgcagctgcccgtgggtgccgcgcaattcctgctccctgacccgcagctccccggtgcgctgctccaccaaccgcagcgcgcgctgccgctggctgaccaggacatatagcagggcactgagcagcaggctcagcagcgtacccaggaccacctggctggacaccgaagaatggttggcctggaggaacaccgcgctggggcggatgttcacctggtaatcatgatcggccaggctcagcacccggctcaccgccagcgggctgtcccccgggccgttgctcgattcatagagtttgccgtacgactcggcggtcgacaggtcgatgatctgcacgaacaggttgtcctggctctgctcgggcagaccatcgaccaccaactggcgcatgctgatcaccgcgatcacataaccgtaaggctcggggggcgacatggccacatcggtgcgcaggctgacgggagtcgccaggatgatgccgcgcgcgtaggaaggctcgactccgaccaagcgcaccggctgcgaaaccgccacgccgccacgctgccgcgcccgctcgagagtgtcgcgacgcattggctgggccagcaggtcgaaccccaggggcgagcccagcgggctttgggtctggctgtagagcaccggtatgtactcatcgcgctcggcagctcgctgcagcttgccttcggcattcaggtcggcaatgaaataatccggcgctccctgttcctgcgccatgcgctcgaacgacgcccgctcggcaccgctgacgcgcggcgcccaggcgtaggcctgggtgcgatgcaagagaggttgggtgtagccgtcgaaatcctggcgcgagaccgcgccggaattgatgaagaagcgcttgagaccatccaggcgctgctcctgatcttcgaagcgctcttcgatgcggctataacgttcgctggccagcagctggaaacgttggcgcaactgctgctgatacagattgagggtcgaccaggccagcagcccggtcaatacgcagccaaacagcaataccactaacgcgaccagccaggccgacacgtcttcgctgatgaagcccaggattttcgggcgtaccgagtgcaacgacataagcaaaactcataacgccagcgaacgtgagcgtcacatgggcttgcattgagttatagctattcgccactaatttggctagagcaaagagccttgaaaatcaaggctctgtggatccaatcaacatcagcgggcggtgattttccaggcccggtggatcttgccgttacgggcgaaatccgggtcgatggtcttggcggtgatctcctcgacggcataacgcaccgccaggttttcctcgagctggaacttgcggaagttgttggagaagtacagcacgccaccgctggccaaccgggccatggccaggtcgagcagttgcacgtggtcccgctgcacgtcgaacaccccttccatgcgcttggagttggagaaggtcggcgggtcgatgaagatcaggtcgaactcatcgcggcaggtctccagccaggccatgacatcgccctgctccagacggttcttgtcggagaaaccgttgagcgacaggttgcgtcgcgcccagtccaggtaggttttcgacaggtcgacgctggtggtgctgcgcgcgccgcccttggccgcgtgcacactggcggtggcggtatagcagaacaggttgaggaaacgcttgccggcggcttctttctggatccgcaggcgcatcggccggtggtcgaggaacagcccggtgtcgagatagtcggtgaggttgaccagcagcttcacgccgccttcgctgacctcggtgaacttgccctgggcgctctggcgttcgtactgcttggtgccgctctggcgctcgcgacgcttgatcaccacccggctcttgtcgacgttcaacgcttgcggaatggccgccagggcatcgaacagacgggcctgggccttttccgggtcgatggatttcggcgcggcgtattcctgcacgtgcacccaatcgtggtacaggtcaatggccagggaatattccggcatgtcggcatcgtagacgcgatagcagtcgacgccttcgcgcttggcccacttgcccagcaacttgaggttcttctgcaggcggttggcgaacatctgcccgccttcgctcaggcgtgcctgctcgaccacaggggctggcgccggcgccggtttgatcgggttgccgttcttgttgtactggcgctcctgcggaaccagcggcgccttgtcggcctcggcctgttcacgctcgatctgccgttgctccggggtacggcgctcaccggtgacgaactgatccggctgcaccttgatcaacagcagcttgcacggcaaggcgccgttccagaacgaatactgcttgtggctgcggatacccatgcgcttgcccaggtccggcgcgccggtgaacaccgccgcttcccagcccaggcaggcctgacgcaggcgctcgcccaggttctggtagagatacagcaggctggcttcgtcacccaggcgctcgccgtagggcgggttgctgatcaccaggcctttctggttctggtccgggcgcggctcgaaggtcgccacttcaccctggtagatcttgatccactcactgaggccggcacgctcgacgttgttgcgccctggctggatcagccgcgggtcggcttcgtaaccgcgaatccacagcggcggcttggccaggccggcctgggcccgcgcctgggcttcttcatgcagcttgcgccacagggccgggacgtgaccgagccaggcagtgaaaccccattgctcgcgcttgaggttgggggcgatgtcggcggcgatcatcgctgcttccaccaggaaggtccccacgccgcacattgggtcggccagggcgccaccattggccgcgatacgtggccagccggaacggatcaggatcgccgccgcgaggttttccttcagcggcgccgcgccctgctgcaggcgatagccgcgctggtgcaggctgtggccggacaggtcgagagagaggatggcttcgccgcgatccaggcgcaggtgaatgcgtaggtccgggttgagcttgtcgatggagggacgctcgccggtcggtgtgcgcagccggtcgacgatggcgtccttgaccttcaaggcaccgaagtgagtgttgtcgatgcccgagccgtggccgctgaactccaccgccagggtgccgtccgccagcatgtggtcctgccagtcgacgtcatgcacgccgtgatagaggtcttcggcgtccttcatcgggaagcgcttgagcaccagcagtacccggttggccaggcgcgaccagaggcacaggcggtaggcggtctccatgtcggccatgccgcgcacggccgaggtatgttcgcgcgcgtcttcaaggccaagcccggcggcttcctcgatgagcaggccttcaaggcctttgggacaggtgaggaagagttcgtagcgatccgacatgggagttcagggcctttagcaataagtgaacggacaacgcatcgtccgcccggttttcaatcaagcgcttttcttgaagagcgctcgcgtggcacgaatctgtgccgtcccgcccctgctgttcagctcgccgctagcggtgaccactggggtcaaaagagcttagatgccagggcagataataaagtcagcgaaacaaaaggtcataactcgacctttcatcgaataatacctgagtgcaacggaatggaattctcactaaagcattaagcccatcatccagtaagaggctgatcagagcgaggtttgcctgatcaacccgatgtaaagcaggccgttcttatggcctcaacatcattatcgttacgtccttatgacaaaacgatcattccatcgttgtgacgcattggttagaaatcaactcaggttggcgccgcaatgacgccaacgccacgctcgcgacgccggcagcgagcaccaacggcagaagcattctgcccggcctcaaacgaggccgacgggacataagacagtcaacaagtgagggaaacaccctatgagaagacttaagcgtgatccgttggaaagagcatttttgcgcggatatcagtatggcgttcatggcaagtcccgtgagctttgcccatttactctaccgtcggtacgccaagcctggatcaatggctggcgcgaaggacgcggcgacaactgggacggtatgaccggcactgcgggaatccacagactcaacgaacttcacgccgtcggctaaaacagggcacacattccgacaccaaaatctgaatatgtaacgacttaaccacgcacgtcccatccggacggcgggctgcggcccaggggctcctttcaggagccctttttattggccgcgcaaaaagccgctgtcctcagcgcaacgcggcgatcgcgtccaccgattcgcgaatcagcgccgggcccttgtagatgaagcccgaatacaactgcaccaggctggcgccggcagcgatcttttccgccgcatgcttgccttcggtgataccgcccaccgcgatgatcggcaaacgtccggccagctcgcccgccagcaccttcacggtgtgggtgctcttgtcgcgcaccggcgcgccggacaggccgcccgcctcgtcgccatgctccatgccttcgacaccgacgcggctcagggtggtgttggtggcgatgaccgcgtccatcccggtctcgatcagggcttgcgccacttcggcggtttcttcgtcggtcatgtccggggcgatcttgatcgccagcggtacccgcttgccatgctgcaccgccaactcctgctgacgctggctgagggcgccgagcagctgcttgagcgactcgccgaactgcaggctgcgcaggcccggggtgttgggcgaactgacgttgaccgtcacgtagctggcgtgggcatacaccttgtccaggcagatcaggtagtcatccacggcgcgctcgaccggagtgtcgaagttcttgccgatgttgatccccagcacgcccttgtatttggccgccgccacccgggccagcaggtgatcgacgcccaggttgttgaagcccatgcggttgatgatcgcctcggcttccggcaagcggaagatccgtggcttggggttgcccggctgcgggcgcggagtgatggtgccgatttcgacgaatccgaaacccaattgggcgaagccgtcgatggccgcaccgttcttgtccaggccggccgcgaggccgaccgggttcgggaagtccaggcccatgaccttcaccggcatctgcgccggcgccttgcacagcaagccattgaggcccaaacgcccgcccgcgccgatcaggtccagggacagatcgtgggaggtttccggggagagtttgaacaacagctggcgggccagggtatacatgggcgggcttgactcggtggcggcgaaatgaggcggcgattatagccgggcatggaggccgcaggcgaggcacgcggcgaaatcagcggtgaatggcatatgccttgcaccacaacctgcatcagcacccaggccaatggcggcgtgggtcgaaagacaaaggcgtcgttaccccgccagctctgcctggcgcgcgggtgcgacgtttttttatggaagctttttttatggccgcttttttatggaggacgccaccccatgaatgaactccccgtcagcccgctggcctgggtcaacggcagcgatgccccggaaaagaccgcgatcaacctcggtttcatggccttgagcgactgcgcctcggtggtggtcgccgccacccagggcttcgcccagccttacggcctgaccctgaacctcaagcgccaggcatcctgggccaacctgcgggacaagctggtgagcggcgagctggatgccgcccacagcctgtacggcctggtctacgccgtgcacctgggtatcggcggggtcaacgccagcgacatggcggtgctgatggggctgaaccagaacggccagagcatcaacctctcgcgggagctgcaagccctgaacgtgaccactcctgaagcgcttcacctgcacgtgcaccaaagccgggcaaggctgaccttcgcccagaccttccccaccggtacccacgccatgtggctgtattactggctggccgcccagggcatccacccgttgcaggacgtcgacagcgtggtggtgccgccgccgcaaatggtcgcgcacctgcaggccgggcgcatcgacggcttctgcgtgggtgaaccctggagcgccagcgcggtgaaccagaacctgggcttcaccctggccaccagccagtcgatctggcccgaccacccggaaaaagtcctcggctgcacccgtgccttcgtcgagcagtacccgaacaccgcccgggccctggtcatggcgatcctcgaggccagccgcttcatcgagcagagccgcgagaaccgccagagcaccgcgcaactgctgagcgcccgcgagtacctcgatgcgccgctggactgcatcgagccacgcctgctcggcgaatatgccgacggcctcggccaccgctggcaggacccgcacgcgctacgctttcataatgaaggcgcggtcaacctgccgtatctgtccgacggcatgtggttcatgacccagttccgccgctggggcctgctgcgcgaagacccggattacctgggcatcgcgcgccaggtgcagcaactcgagctctatcgtgaagccgccaccgccgtcggcgtcgcgtcctggggccaggacatgcgcagcagccagttgatcgacggcaagcggtgggacggttcggacccggccgcctatgcccgcagcttccagctgcacgccatgagcgacagctcgcctcttctcgccagccgctgacaggagcccgagaccatgttgcgtatcctgctgatcaacgacaccgccaagaaggtcggtcggctcaaggcggccctgatggaagccggtttcgaggtgatcgacgagtcgggcctgaccatcgacctgccgacgcgcgtcgaaacggtgcgtccggacgtgatcctgatcgataccgaatcaccgagccgcgatgtgatggagcaagtggtgctggtcagccgcgaccagccacggccgatcgtgatgttcaccgacgagcacgaccccgacgtgatgcgccacgccatcaagtccggggtcagtgcctacatagtcgaaggcatccaggcccagcgcctgcagcccattctcgacgtggccatggcccgcttcgagagcgaccaggccttgcgtgcgcagctgcaggcccgcgaccagcaactggccgagcgcaagcgcatcgagctggccaagggcctgttgatgaagatgaaagactgcaacgaagaacaggcctacaccctgatgcgccgccaggccatgagccgccagcagaagctgatccaggtggccgagcagatcatcgccatgagcgagttgctgggctgaatcccgcagctgtggtgcggcggcctatcgcgggcagcctctcctacggaagaagaccgtgagtttctgtaggcgcgaggcttgcccgcgatccggaacaccaggactgcaactcttggcacaaatctggctatgtaatcgacacaggtaaccaacggcggttgccccacctacgacaaagacgtcgcacacccttctcgccccaggcgaaacgggttgcggcgttttttcgttttggccccacagcccggggccggtggagcggccgtaatggcgccccacgcaaaagctcatgactcctttcgagactcttaacagctgaggtgcgcgatgaattcaagcttctggaaatccggccacaccccgacattgttcgcggccttcctctacttcgacctgagcttcatggtctggtacctgctcggcccgctggccgtgcagatcgccgccgacctgcaactgaccacccagcagcgcgggctgatggtggccacgccgatcctggccggcgccgtgctgcggttcgccatgggcctgctggccgatcgcctgtcccccaagaccgccgggctgatcggccaggtgattgtcatcggcgcgctgttctgcgcctggaagctgggcatccacagctatgaacaggccctgctgctggggctgttcctgggcatggccggcgcttcgttcgccgtggccctgccgctggcctcgcaatggtatccaccacagcaccaaggcaaggcgatgggcatcgccggggccggcaactccggcacggtattcgcggcgctgttcgcgcccttgctggccggcgccttcggctggagcaacgtgttcggcttcgccttgatcccactgatcctgaccctggtgctgttcgcctggctggccaggaacgccccggaacggcccaaggccaaatccatggccgactacttcaaggccctgggcgaccgcgacagctggtggttcatgttcttctacagcgtgaccttcggcggcttcatcggcctggccagcgccctgcccggctacttcaacgaccagtacggcctgagcccggtcaccgccggctactacaccgccgcctgcgtgttcggcggcagcctgatgcgcccgctgggcggcgcgctggccgatcgtttcggcggcattcgcaccctgctggtgatgtacagcgtcgcggcggtgtgcatcgccgcggtcggtttcaacctgcccagctcctacgcggccctggccctgttcgtgtgcaccatgctcggcctgggtgcgggtaacggcgcggtcttccagttggtgccacaacgtttccgacgcgagatcggggtgatgaccgggctgatcggcatggccggcggcatcggcggtttcgccctggccgcgggcatgggcgcgatcaagcaaagcaccggcagctaccagctggccctgtggctgttcgccagcctgggcgtgctggcctggttcggcctgcacggagtgaaacgccgctggcggaccacctggggctccgccgctgtcacggcggcgcgggtctgagccgtccatgagcctgcgactgagccacgcccaggccagcgccatcggtccgcgcgcggagaaccaggacgccttgcgcctggtcaccccggcgccgaccctggccgccagcaagggcctgctgttcgccatcgccgacggtgtcagccaatgcgccgatggcggcctggccgcgcgctcgaccttgcaggcgctggcgctggactactacgccaccccggaaacctgggccgtggcccaggccctggaacgcctgctgctggcgcagaatcgctggctgcaggccaatggcggcggccagccgctgctgaccaccgtcagcgccctggtgctgcgcggccggcgctttaccctggcccatgtcggcgattgccgggtctatcgctggcatgccgatcagttgcaacgcatcagcgacgatcatgtctgggaccaacccggcatgcagcatgtgctcaagcgtgccctgggcctggaccagcacctggtggtggatttcctcgatggcgagctgcgggaaaacgaaagtttcctgatgctcagcgatggcgtctgggcgaccctgggcgacaccgccatcgccgccatcctgcgcgaccagcccgacctcgacagcgcggtgcagaccctggtcagcgccgcgcacctggccggcagccaggacaatgccagcgccctgctggtgcgggtcgaagccctgggcgaaagctccatcggcgacgctctgattcacttgcagcaatggccactgccgccgcccctcaagccgggccagcacttcgaaggctggcaggtcgtcgaggtgctcgggcacagccagcaatccctgctgtaccgcgtgcttgatgcgcaacaacaacaacaacaacaacaacaacaacaacaacaacaacaacaacaacaacaacaacaaccctggctgctgaaaaccctgcccggtcatctgcacgacgatcatcaggccgggcaatcgctgctgtcagaggagtggttcctgcgccgggtggccggccggcactttcccgaagtgcatgccgcgaccgcccgccaacacctgtattacgtgatgcgcgaatacccggggcagaccctggccgagcatctgcaacaacatggccccttgccactggcgcagtggcaggacctggccgagcgcctgctgcgggccgtgggcctgctgcaccgccggcagatcctgcaccgcgacatcaagccggaaaacctgctgctcggggacgacggcgagctgcgcctgctggatttcggcctggcctattgccccggcctgtccgaggaccaggcgcacctgctgcccggcaccccgagctatatcgccccagaggctttcaacggcgtggcgccgacaccgcggcaggacctgtacgcggtaggcgtgaccctctaccacttgctgaccgggcattttccctacggcgaaatcgaagccttccagcgcccgcgcttcaccaccccggtcaacgccagccgctatcgcccggacctgccggactggctcgaacagagcctggaacgcgcggtacaggccgatccggcccagcgttatgaaaccgccgaagagtggttactggtgctggaacagggcgagcgccgcagcctcagcgtgcgccccagaccgctgctggaacgcgagcccttgaaaatctggcgcaccctggcgctggtctcgctgttgctcaacctgctgttgctgtacctgttcctgcaccactgacctcactgttttcctgtagccgctgccgcaggctgcgaccgacggcgtagccggcgtaaggcggtatcccctacctgcgggtaaaaccgcgtcgtcaggttctgcggcccctgcggtgccgatcgcagcctgcggcagtggctacagggatcgcgcagcgtgcgccagaagtgggcaagacgctttgaatcggtgcagaaaacccaccttaccggcctgagacaggtttccaggcctactgaaaccgccattggcgggacttggcacaaccgctgcattaattctcccaacagcacatacgacccggccttcaacgacgaaggatgggttttcccgagagaacgggaccggacaaaggcgtcctgccaggcaactggcgggacgccttttttgtttgcgcaacgtttatcgagccaggcccggcatgcccgacggcctgtctacgcggagagcgaaatgaacaaactcaagctggtgatgatcggcaacggcatggccggggtacgcaccctggaagagctgctcaaactgagcaatgagctgtacgacatcacggtcttcggcgcggaaccccacaccaactacaaccgcatcctgctctccccggtactggccggcgaacagaccttcgaagagatcgtgctcaacgacctcagctggtacctggacaatcacatcaagctgctgctcaaccgcaaagtggtgcagatcgaccgggtcaagcgccgggtgatcgccgaagacggcagcgaagccgagtacgaccgcctgctaatcgccaccggctcgaccccgttcatcctgccaattcccggcaacgacctgcagggcgtgatcggctaccgcgatatcgccgacacccaggcgatgatcgacaccgccaagacccacaagcacgcggtggtcatcggcggcggcctgctcggcctggaagccgccaacggcctgatgctgcgcggcatggacgtgaccgtggtgcacatcggcgaatggctgctggagcgccagctggacaagaccagcggccaactgctgcaaagcgccctggaaagccgcggcctgaaattccgcctgagcgaacagacccaggccctgcacgacgcgggcaatggccgggtcggctcggtgcagttcaagaacggcgacatcatccccgccgacctggtggtgatggccgccggcatccggcccaataccgagctggcggaaaaagccgggctgccgtgcagccgcgggatcctggtcaacgacaccctgcagacctacgacccacgcatctacgccatcggcgaatgcgccagccatcgcggcatcgcctacggcctggtggcgccgctgttcgaacaggccaaggtctgcgccaaccacctcgctcaactgggcttcgccacttacaagggctcggtgacctcgaccaagctgaaagtcaccggcatcgacctgttctccgccggcgacttcatgggcggcgaaggcaccgagaccatcaccctctccgaccccatcggcggcgtgtacaagaagctggtgatcaaggacgacatcctggtcggcgcctgcctgtatggcgacaccgccgacggcggctggtacttccggcagatccgcgagaaccacgccatcggcgagatccgcgaccacctgatgttcggcgagaacgccctaggcgacgtcggccaccagggccaggacaaggccatgagcatggccgacagcgccgaagtctgcggctgcaacggcgtgtgcaagggcaccatcgtcaaggcgatccaggaacacggcctgttcagcgtcgacgaggtcaagaagcacaccaaggccgccagttcctgcggctcctgtgccggcctggtggaacagatcctgatcaacaccgtgggtggcgcggccgacgtcaagccgaaaagcgagaaagccatctgcggctgcagcgacctcaaccacgggcagatccgccaggcgatccgcgaacagcacctgttgaccatcgccggcaccatgagctacctgaactggcgcacgcccaatggctgcgccagctgccgcccggcgctgaactactacctgattgccacctggccaggcgaagccagggacgacccgcaatcgcgcctgatcaacgaacgggcccacgccaatatccagaaagacggcacctattcggtggtgccgcggatgtggggcggcgtcaccaccccctccgaactgcggcgcatcgccgacgtggcggacaagtaccaggtgccgatggtcaaggtcaccggcggccagcgcatcgaccttttgggtatcaagaagcaggatttgcccggggtctggaaagacctggacatgccctccggccacgcctacggcaagtccatccgcaccgtgaaaacctgcgtcggcagcgagttctgccgcttcggcacgcagaactccacccagctgggcatcgagctggagcatgacctgttcaacatgtggtcgccgcacaaggtcaagctggcggtctccggctgcccacgcaactgcgccgaggccgggatcaaggacgtcggcatcatcggcgtcgactcgggctgggagatgtatatcggtggtaacggcgggatcaagaccgaggtcgcggagttcttcgtcaagctgaaaaccgccgacgaagtgcgcgaatacaacggcgctttcctgcagctgtaccgcgaggaagccttctacctggagcgcaccgtgcactacctgcaacgggtcggcatggctcacatcaagcaggccatcatcgaagacccgcaacggcgcaagaccctcaacgagcgcctgcaattctccctgtccttcgaacaggacccgtggaaggagcgtctggaacagccgcagctgaaaaaagagttcgagccgatccgcgtcaagccactggaggtgctgccatgaactggctggatatctgcgccctggacgagatcaacgccctgggctcgcgcatcgtcaacggccccaagggcgacatcgcgatctttcgcaccagcgacgacgaagtcttcgccctcgacgaccgttgcccgcacaaaggcgggccactgtcccaggggctgatctacggcaagacggtcgcctgcccgttgcacaactggcagatcgacctggagtccggcgaagcacaggcgccggatatcggctgcgcccatcaccatctggcgcgggtggaaaacggccgcgtgctgctggccctgcgggatgccggctgatgaaccgccagacgaccgcctcgacctgctgttactgcggcgttggctgtggcgtgctgatcgagcacgacggcgaacgcatcctcggcgtcagtggcgacccgagccacccggccaaccacggcaaactgtgcagcaagggttccaccctgcacctgaccggcgacctcgcagcccgcgccctgtatccggaattgcgcctgggcaaggccctggcgcgcagccgcacagactgggacaccgcactggaacacgcggccaacctgtttgccgaaaccatcgccgaacacggcccggacagcgtggccttctatatctcagggcaattgcttaccgaggattactacgccttcaacaagctggcccgggccctggtgggcaccaacaacatcgacagcaattcgcggctgtgcatgtcctcggcggtggtcggctacaaacgcagcctgggcgccgacgccccgccctgcagctacgaagacctcgaactgagcgattgcgtgatgatcgtcggcagcaacatggcctacgcccatccggtgctgttccgccgcctggagcaggccaagcgcctgcggccgcagatgaaagtgatcgtcatcgacccgcggcgcaccgacacttgcgatctggccgattcgcacctggcgattctgcccggcaccgatgtcgcgctgttccacggcatcctgcacctgctgctgtggcaggactggatcgatcgcgacttcatccaggcgcataccgaaggcctggccgagctgaaaaacctggtccacgactacaccccgcatatggtcgcgcagctgtgcggcatcagcgtcgagcaactgcgccagtgcgccgaatgggtcggcaccttgccgagcttcctgtcgctgtggtgcatggggctgaaccagtccagtgctggcagcgcgaaaaacagcgcgctgatcaacctgcacctggccaccgggcagatcggccgccccggggccggccctttctccctcaccggccagccgaatgccatgggcggccgggaaaccggcagcctgtcgaacctgctgccgggacaccgggacgccgccaacccggagcaccgggctgaagtcgcggcctactggggtgtcgagcaattgccggccaaccccggcctgagcgcgatcgagctgttcgaacagctgcgcggcggcaagatcaaggcgctgtggatcgcctgcaccaacccggcgcagtcgctgcccgaccagaacgcggtgcgagaagccttgctggcctgcccgttcgtggtcctgcaggaagcctttcgcaccaccgagaccgcggcctttgccgacctgctgctgcccgccgccagctggggcgagaaggaaggcagcgtgaccaactcggaacggcgcatctcccatgtacgccgcgccgtggccgcgccgggcgaagcacgcccggattgggccatcaccctggacttcgcccggcgcctggaacagcgcctgcgtccgcaacggcccagcctgttcgccctggatacgcctgcccagctgttcgatgagtacaaactgctgacccgcggccgcgacctggacctttccggcatcagccacgcgctgatcgaccgtatcggcccgcagcaatggcccttccccgccggtgccgaacaggggacgccgcggctgtacgtcgacggccgcttcccgaccgccagcgggcgggcgcacttcgtcagcgacccatatcgcgcggccaaggaacagcgggatgcgcgcttccccctgaccctgatcaccggccgcctgcgcgatcaatggcacggcatgagccgcaccggcaccgcggcccagctgtttgggcacgtcagcgaagccgtcctcagcctgcacccggacgaactgcgccggcagaacctgcaagcgggtgaactggtctcgctgaaaagccgtcgcggcagcgtggtagtcgccgtggccgatgacgacagcgtgcgcccgggccaggctttcctgccgatgcactggggcgatcggtttctcaagggcggcgtcaatgccgtgactcagccggcgttcgatccactgtccaaacagccggaactcaagcacagcggtgtacgcctggagccggtccagctgccgtggcaattgttcgccctgatcgaaggcgacgtgcagcggcatttcgaagccctgcgcccgctctgtgaaagtttcgcctacgtcagcctgagcctggccggccgcgaacgcccggccctgctactgcgggtggccaatgccgaggcgccggcgccgcaactgctcaaggacatcgaccagttgctggggctcaacgaaggcccggtgctggcctatgacgatcctcggcgctccatcggcaagcgggttcgcatcgaacaggggcggatcaccgccattcgcctggccggtgaaaccctcgcccggcactggctgcagaacctgtggctggaaggcaaggccgatgagcaactgcgccgttggctgctggcgccgatgagcgcaccgccaggggcggccgggctcgcctcgagcggcaagaccttgtgcaactgcaagaacgtcagccagagcgcggtctgtgccgggatctcccgcggcctggacctcgatggcctgaaacaggaactgggctgcggcactcaatgcggctcctgcgtccccgaaatcaaacgtctgctggccagctcggcacagcccgtcgcaatccccctgtgaggaaacaaacatgagcgcaaaagtctggctggtgggtgcgggccctggcgatcctgaactgctgaccctcaaggccgtgcgtgccctgggcgaggcggatgtggtgctgatcgacgacctggtgaatccggcggtgctggagcactgtccccaggcacgggtcatcgccgtgggtaaacgcggaggctgtcgttcgacgccccaggcgttcattcaccggctgatgctgcgctacgcccgtcatggcaagtgcgtggtacgtctcaagggtggcgatccatgcatcttcggacgtggcggtgaagaagcgcagtggctgcaggagcgtggcgtcgaggtggaactggtgaacggcatcaccgccggcctggcgggcgctacccagtgcggtatcccgctgaccctgcgcggtgtcgcccgtggcgtcaccctgctgacggcccatacccaggacgacagcagcctgaactggcaagccctggcgcaaagcggcacaacgctggtgatctatatgggggtggcaaaactgggcgagatacgtgaacagctgatcgctggcggcctggcaccgcataccccggtggccatgattgaaaacgcatccctacccgagcaacggctgtgtcggagcgctctgcacgtcatgcaggacgatgcccatgccttcctgctgaaaagcccggccatcctggtcgtcggcgaagtggctgcctgcggcgcacaactgcccgccctttccgaggcggccctggcggccgcactttcggcctgacgccaggctctttcaacaaatcgcggacaaagaaaaacccggcctaggccgggtttttcaaagctgcaagctacagattactgagcttgttgagcttgtgcttcaacctgcgcttctacgcgacggtttacagcgcggccagcttcagttgcgttgtcagcaactgggcgggactcaccgtaaccaacggattgaacgcggctcgactcaacaccgtactggctggtcagaacttgcttaacggcgtttgcacgacgctcagacagtttctggttgtaagcgtcaggaccgacggagtcagtgtgaccttcaacaacggtggtggtttgtgggtactgcttcatgaagtcagcgaggttcttgatgtcagcgtagctgttaggcttaacgaccgacttgtcgaagtcgaacttcacgtccagctcaacacgaacaacttcagcaaccggagcttctggttctggagttggctctggaactggagcaggagctggagcaaccttgccagcgttgccgccgaagttcacacccagaccaaccagagcggagtagtcccacttgccgttgtccattgcgtagtcggcttcaacaccggcacgagcgaacaggttgtcggtgaagtagtacttaacaccggtaccgatgatagccagggtcgactggtcgcgaccgctgtggccgtcagccaggacgttggtacggctctggtgaccgaaaccaccggaaacgtatggacgcagggagtccacgccagcttgaccgaagtggtaggtagccagcaggctgccggtgtcacctttgatcttctggttgccagtgccgtcgttcgaacgggtgtggttggttttgtcgtagttcaggtccaacgacaggtcatcggtcaggaagtagccgatacgagcgcctgggttgaagccgtcttcgatgtgcttaacgctgtcgttgtactgttttttgtaaaacagttcaccctcgaccgcgccttggccttgcgccagaacgccgaacgaagtcacggcaacaatagaaccaatggcaatgcccaaggtgtttttcagtttcatccgttaaatccccatctggtgattgtaaagcagtcccacataccgggggacaactcggcggtaagtctatcagaacttacctagacgtaagagatatttgcgccgaactaagtttcagcaatgcctgcaaatttctcacgcaatttatcaagcgcacgcttgtaccgcattttcgtagcactcaaccccatgtgcatgatgtctgcgatctcctggaactccagctctgcgacgaatcgtagcaccagaatctcccgatcgatcgggttcacatgcaccaaccagcggtcaagtccgcccttttcctcaggtttcggcgccttatcttcagacgcttcctcgaggggatcaagacttaacgcatccatcaagcgacgtttccgccgttctttccgatactgcgtgatgcattcgttgtacgtgatgctatagagccatgtcttgaacttcgatttcccctcgaagttcttgaggccatacagcaccttcaacatcacctcctgacagacatcgtcagcatcacgatcgttccctaaataacgtgcacaaacgttgaagagggttcgctgatagcgtcgcatcaactcttcatacgcacgcgttacgtgaaacagctccgtgtgcgagcgcgcaaccaactcctcgtcagagagctcacgggggtcatagcgcgtggatagcgattgggctttattcaaaacgagtcgggccgacagtcaggtcaatgtccaccgcagcccagacacgggcattttgcggcggcatacattagcagggtttgccgggttagcggctacttacatgctgctccagcatgatccgattggagagagagaccagctcgccctcatcggtcagcagtgtagtcttaaccgtgccgatctcctcgatctgcccttcgacctcgccaactcgcacttgttgcccaacctgatacaactcacgcacatagattcccgcaagaatctgaccggcaatatcccggcttcccaaccccatggccaaggcaacagccagaccaacggtaatcaaaacgatcacgatcacatggttgagcaggtcggttttgacctccaactgactgatcgcaacggaaatactgatgatgatcaccagcccctgggcgattcgccccaggccactggcgtaatccagaccgaccccttcggccgctccgcgcaccagcccattggccaattgcgccagcaatacccccaccaacagcaccagcgcggccccgaaaaccttcggtaaatacaacgccagcatgtcgagcgtagccgaaacccgctccaggccaagggattctgcagcagaaaccagaaaaatcagtaatatgaaccaatacacgattttaccgatcaaggtagaaatcggcacctgcagacccgcacgggacagcagtttggtcaaaccggtaccgcccatcaaacggtccaggcccagtttggcgagcaatttggaaagcagggtatcaagcagtttggcaaccacaaaacccaacagcagcacgaccagcgcgccaaacagattgggaatgaagttcgctaccttggtccacaacgcagtcatcgcagtgacgaggctctgagtccagagatcaagttccatattcaatcagccttatcagcagtgcgagcagtaggtttacgacgggaaaccggcaagatatgggccgatccgttattcagagcaatcatcagcgccggcaaccagcggccgagcaggctgaacagatcgcccgcccccacctgccggttggcggttttaagtacgcggcccaggcacgcatcgtcgtcccgggtggacggtgtggccttgagcatgtcacgcaacgactgttcaaacggatcgtgcatacgcacctctcgatatgtcagtgaaagacgcgatcaaaattccctgggtcacatagttcatgatcagacccagcgcaaacgtcggaataaccaccactgtcccagcgcgaccagcgccatcaacaggcaggccaccagaaacccgtaggggctgttggaaagcggaatgcctcccacattgatccctagcaagccggccagaaaactcatcggcagaaagatcccggtgatgatcccgaagcgaaacatgatgcggttcatgcgcacgctcaggcgtcggtcttcagcctccagcacaagccccacgcgctctcgggtcaattcgagctcttccaggtagcgggtcaggctgttattcaattcgttccagtaatcgccatcgtcatcggcgaaccaaggcagcctgatgcggctgagctgaccgaaaatatcccgctgcggagcgaggaaacgcttgagtccggcagcccgtcgacgaatttgcagaatgttgctgtgctcgggggtataccgttcgtcggcatccagtttttcttcctcggcatcgaccacttccgacaggtcactgaccaggtcctgcactttatgggtcaggtactcagccatataaaggatgagttcggaggcggttttcggtcccttgccttcgcccagttgcaccagcagctcatccgtcgcgcgcaatggccgcaggcgcagggatatcactcgctgggccgaaccgaagatgcgtaccgaaaccatgtcctccggctcggcgccggggttgaggttgatgccgcgtaaaaacagcaggaactcggaatccggcagcgccaacaggcgcggccgggtattttcttcgagtaaaaggtcacagctgaactcgctcagaccgctggatttacgcagccaggtctgggtttgcggatggctgcgatcccaatgcagccagaggctctcatgggcttgcagctgcaagtcgtccagttcagttcgggcaatcgcacgcgcaccacctttaccgtccagcaccagggcatgtaccagcccccattgcgcgttgtcttcctcgaacatcctcatcccttgcttggtcgactgcttattcgggcattttcagcgggcttggcgaaacgattacgccattgttgtcggcatagacatattcgcccggacggaacgtcaccccggcaaaagtcaccgccacgttgagatcaccaataccgcgcttgtcggttttcatcgggtggctggccagcgcctgaacgcccaggtcggtttgcgcgatgacatcgacatcacggatgcaaccgtagatcaccagcccttcccaaccgttcttcgccgccttctcggccagcatatcgcccagcagcgcacggcgcagggagcctccaccgtcgaccaccagcaccttgccgtggcccttgagctcgacctgttccttgaccagcgagttgtcttcgaagcatttgatggtcacgatttcgccgccgaaggagtcgcggccaccgaaattgctgaacatcggttcaaccacctgcaccagatccgggtaggcgtcgcacaggtcgggagtgaggtaatgattcatcgagaaactcctgtaatggaaagaacacgtcgcggtgtcggaattcgcagggttcatgctgagtgatacgagggcagacggagaatgtttaacatttcagctagccctcaccatacgccaatttcagcaggctcgacggcacgaacagaatgcttaaccggcgaccgaatgtgaccagaaccgctcagtgcgtcatatcttagccgcaagcgcatcggaacgaaatgctcttgtcagagccttctgaactcaactggcggcagccagttcggtgcccgacgccaacaacgggctctgctgatccttcaaccatcgcgcgaccaaaggccagacttcagcctgggcggctttgctcaccagcatctccacatggccaaaattgccgctaaacccttgttcgcgtcccaggcagacaaactgcttatgctcggaactcaactggtcaaacagcttgcgacaagcccaggtcggatcctgatgatccccggccgcactcaccgccaataccggcagcgaaacatcggacaagccggcccaccagtccttctgcccatcgccgaaacgcccgaacagcccgtaccagcgcatgccttccagggccaggccaatgggctcgtcctcgggaccgcgcttgagtcgcgagccggacaactgggcaaaacgcttgagaatgaaacgaccgccccactccaccgccgggattttcaatggccaataggtgcggctgacctgacagccgaacagcgccgccgacgccactgccggctctcccaggtactggccgcccagggccgccgccagggtaatgccgcccagggaatgaccgatccagtgcggaacctggccgctttgttcccgcacgaaggcgccgatggcgggcagatcgtattgcgcatagtcggcgacgcgattcttgcggtagtcggcattgcgtcgcgacaggccgtgaccacgcatctcgggaatccatacatcgaaacccatgcgcgccagatacgcgcccaggccgatgcccttgggcgaataccagaagcgccggttggagaagctgccgtgcagcaggatcaccgggacaccgcgggattcgggctcgtccgccatccccaggcgggtgatggccagctcgaccgtggcgtccgggctattgccgggcttcaggcggtagacgtcttcactcaggtcgcctcgacgttcggcactgatcaaggcgacgggaaacaggttgctgctgctttgcataatgctcttgcacaaaaaagggcggcttccagatggagcccgccctacttgaatctcaaagcaccggccagcccgaaggctggccagtgcttcattccgcttagaccgcaccctgcccctcggccaggaagaaccaggtttccagtacggaatccgggttcagcgagacgctttcgatgccctgctccatcagccacttggccaggtccggatggtcggacgggccctggccgcaaataccgatgtatttgccggccttgttgcaggcggcgatggcgttggccagcagtttcttgaccgccggattacgctcgtcgaacaggtgcgcgatgatgcccgaatcgcggtccaggcccagggtcagctgggtcaggtcgttggagccgatggagaaaccgtcgaagaactcgaggaactcttcggccaggatcgcgttggaaggcagctcgcacatcatgatcacgcgcaggccgttttcaccacgcttgagaccgttttcggccagcagatccaccacctggctggcttcgcccagagtgcggacgaacggcaccatgatctcgacgttggtcaggcccatgtcgttgcgcacgcgcttgagggcgcggcactcgagctcgaagcagtcacggaaggcttcgctgatgtaacgcgaagcaccgcggaagcccaacatcgggttttcttcttccggctcgtagagcttgccgccgatcaggttggcgtattcgttggacttgaagtccgacaggcgcacgatgacttttttcggccagaacgctgcagccagggtgctgatgccttcaaccagcttatcgacgtaaaaaccgaccggatcgttatagccagcgatgcgcttgtcgacgctgtccttgatttcatggggcaggccggcgtagttcagcagcgccttggggtgcacgccgatcatgcggttgatgatgaactccaggcgggccaggcccacaccggcgttcggcagttgggcgaagtcgaaggcgcggtccgggttgccgacgttcatcatgatcttgaacggcagctccggcatggcgtcgacggagtttttcttcacgtcgaagcccagctcgccttcgaagatgaaaccggtgtcgccttcagcgcaggacacagtcacgccctggccgtctttcaacagttcggtggcattgccgcaaccgacaaccgccgggatccccagctcgcgcgcgatgatcgcggcgtggcaggtacggccgccacggttggtgacgatggcgctggcgcgcttcatcaccggctcccagtccgggtcggtcatgtcggataccagcacgtcgccggcctggaccttgtccatctccgacacgtccttgatgatccgcaccttgccggcgccgatgcgctggccgatggcgcgaccttccaccagcacggtgccggtctccttcaacaggtaacgttccatgacgttggcctgggtgcggctcttcacggtttccggacgggcctggacgatgtacagcttgccgtcgtcgccgtctttggcccattcgatgtccatcgggcacttgtagtgcttctcgatgatcatcgcctgcttggccagctcactgacttcggcatcggtcaggcagaaacgcgcgcgatcggccttgtcgacgtcgacggtcttgaccgagcgaccggccttggcttcgtcgccgtagatcatcttgatcgccttgctgcccaggttgcggcgcaggatggccgggcgaccggcttgcagggtgcccttgtggacgtagaactcgtccgggttcaccgcaccttgaacgacggtttcacccaggccgtaggcgccggtgataaataccacgtcacggaagcccgactcggtgtcgagggtgaacatcacgccggcggtaccggtttccgaacgcaccatgcgctgcacgccggcagacagggcgaccagcttgtggtcgaagccctggtgcacgcggtaggaaatggcacggtcgttgaacagggaagcgaagacttccttggcggcgcgaatgacgttctcgacgccacggatattgaggaaggtttcctgctggccggcgaaggaagcgtccggcaggtcttcggcggtggccgaggagcgcacagccacggccatgtcagggttgcccgcggacagcttggcgaacgcggtgcggatttcgctattcagttgctcggggaactcggcttccatgatccattgacggatctgggcgccggtcttggccagggcattcacgtcatcgacgtccagagcgtcgagcgcggcgtggatctggtcgttaagaccgctcaattcgagaaaatcacgataggcctgggccgtcgtggcaaagcctccagggacggatacaccggcgcctgcaaggttactgatcatctcgcccagggatgcgttcttgccccccacatgctctacatcatggacgccgagcttatcgagggaaactacgtactctaccaaggtgatctctccactaactgtgttggaaaagctcagaagccggctgctcggggagcgcttgccagctgtatggcctggacctggaaaataagtgagaatgcgggccattggaggccggcaaatcgcgcctatcatatccaagattcgtcactagcttaaggcccaaggtgcaaatgaaacgatctgctttctttatctccgacggtaccggcatcaccgctgaaaccctcggccagagcctcctggcgcagttcgaaaacattaccttcagcaaaatcacgcgaccgtatatcgacagcgtagataaagcgcgggccatggtacaacaaatcaacatcgccgccgaaaaggacggatttcgcccgattatcttcgacaccatcgtcaatcaggacatccgtgagatcctcgcgacgtccaatggtttcatgatcgacatcttctcgaccttcctcgcccccctcgaactggagttgagcgagcactcgtcgtattcagtcggcaagtcccattccattggcggcaactccaactatatggagcggatcgaggcggtgaacttcgccctcgacaacgacgacggcgcccgcacccactactacgacaaggccgacctgatcctggtcggcgtgtcgcgctgcggcaagaccccgacctgcctgtatatggccatgcagttcgggatccgcgccgccaactacccactgaccgaagacgacatggaacgcctgcagctgccgacggcccttcgcgcccaccagcacaagctgttcggcctgaccatcgaccccgaccggctcaccgccatccgcaacgagcgcaagcccaacagccgttattcgagctatgcccagtgcgagttcgaagtacgcgaggtggaaaacctgttccgccgcgagaacattccgcacatcaattccacccatttctcggtggaagagatctcggcgaagatcctcgtggaaaaaggcgtcgagcggcgcttcaagtagagttatctgaccaatagaaggctatcgcgagcaatcgagcatcgaccggctgctcctacatggcttacaagatcttgtaggagcgagcttgtcgtgatcggaccaacggtccgccctgccctcagatcaccaacaggtccacgaaccggtgtaccgccgtggcttccagctgcgcctggtccttgcacagggcaaagatctgcgccgagcgctgggcggtgaagcgggtggccaagttggccttgaacttgtcttccagcagcgcaatgccttcggcgcgacgccggcgatggccaatcgggtattccaccaccacctgctcggtgctcgagccatccttgaaaaacacctgcagcgcattggcgatggagcgcttgtcggcctccaggtactcgcgggtgtagcgcggctcctcgactatctgcatcttctcgcgcaactggtcgatgatcgggtgggcggcatggaagtcgtcttcatagtgctcggccaccaggttgccgaacgccagcggcacggcggtcatgtactggatgcagtggtcgcggtcggcggcgttggccagcgggccgaccttggaaatgatgcggatcgccgattcatgggtggtgatgacgatcctgtcgatctcgtgcaggcgattgcgcaccagcgggtgcagggtcaccgccgcttcacaggcggtctgcgcatggaactcggccgggaagctgatcttgaacagcacgttttccatcacatagctgccgtactgctgcgacaggctgaaacggcgctggtcttcgggcttgagcgccaggtccttgttggtgtggctgaatagcacgtcgtagaagccccactgcggcgcgctcagtactcccgggatgcccatctcgccacgcagggcgatatccgccaggcgtacgccacggctggtggcatcccccgccgcccaggacttgcgcgaaccggcattcggcgcatggcggtaggtacgcagcgcctggccatcgacaaaggcatgggacagcgccgccagcagctgctcgcggttggcccccatcaacttggcggtgaccgcggtcgaggcgacttttaccagcaagacatggtcgagaccgacccggttgaaggagttttccagggcaatcaccccctggatctcatgggccatgatcatagcctcgagcaccgcgcgcatggtcagcggcgcctcgccattggccacgcgcttttgcgacaggtgatcggccacggcgaggatgccaccgaggttgtcggaaggatggccccactcggcggcgagccaggtgtcgttgtaatccagccaacggacaatgcagccgatatcccaggccgccttgaccgggtccaggcgcaagctagtacccggcacccgcgcgccaaacggcacgagcgtgccctcgacgatgggccccaggtgctttgtacactcgggaaagcgcagggccagcaagccacagccgagggtgtccatcaggcagttgcgggcggtatccagagcctcgcgggactcgatccggtagttcagaacgtaatcggcaatgtcctgcaggacctggtcgtaatcggggcgttcgttcagatcaacgttggcgctcatgggcagttcactccatcaagggttgggtgtgggttgcatcctcaaggtcaggctgatcgggttattttttattcaccccattgtaggagcgagcttgctcgcgatgacggatggactgtcgacatcgatgtcgaccgtggtatcgctatcgcgagcaagctcgctcctacaggggccgcttatgatttagaacgcgtcgccgggcacacgcacccaaccttccatcaagacccgcgcgctacgactcatgatggccttggtcacgctccattcgccgttgtcctgcacggcttcggcgccgacgcgcagggttcccgacgggtggccgaagcgcaccgcgctgcgctctccgccgccggccgccaggttgaccagggtcccggggatcgccgctgccgtgccaatggccaccgcggcggtgcccatcatcgcgtggtgcagcttgcccatggacagcgcgcgcaccagcagatcgacatccgcggccttcaccgccttgccgctggaagcctggtagtccgcgggcggcgcgacaaaggcgaccttgggcgtgtgctgacgcttggccgcttcatccagattctggatcagccccatgcgcagcgcgccgtgggcgcggatggtctcgaacatcgccagcgccttgggatcgccgttgatatcgccctgcagctcggtaccgctgtagccgatgtcgcgggcgttgatgaagatcgtcgggatcccggcattgatcatggtggcctggaaagtcccgacgcccggcacctccaggtcgtccaccaggttgccggtggggaacatcgaaccaccggcgccctcttcctcggccgccgggtcaaggaactccagctgcacttcggccgccgggaaagtcaccccgtccagctcgaaatcgccggtttcctggaccgcgccgttggtgatcggcacgtgggcgatgatggtcttgccgatattggcctgccagatacgcaccaccgccacgccgttctgcggaatgcgctcggcatccaccaggccgctgctgatggcgaaggaaccgaccgccgccgacaggttgccgcagttgccgctccagtcgacgaaaggtttgtcgatggacacctggccgaacaggtaatccacgtcgtggccgggcttgatgcttttcgacaggatcaccgtcttgctggtgctggacgtggcgccgcccatgccgtcgatctgcttgtcgtacgggtcggggctgccgatcacccgcaacagcaaggcatcgcgggccgcgcccggtagctgcgccgcttcaggaaggtcctgcaggctgaagaacacacccttgctggtgccgccccgcatgtaggtggcgggaatcttgatttgcgctacgaaagccatgagttttcggtcctgataaagaccgagggcggcgccttgcggcccgcccccggtacgtcacttaactggccacagccgattcgaggaagtcctgggcaaagcgctgcaacaccccgcccgcttcgtagatcgacacctcttcggcggtgtcgagccggcaggtcaccggcacctcgacccgctcgccgttcttgcgctggatcaccagggtcaacgtggcgcgcggcttgcgctcgcccaccacatcgaaggtttcggtgccgtcgatgcccagggtcttgcggtcggtgcccggtttgaactccagcggcagcacgcccatgcccaccaggttggtgcgatggatgcgctcgaagccttcggcggcgatggcttccaccccggccaggcgcacgcccttggccgcccagtcacgggacgaaccctggccgtagtcggcgccggcgatgatgatcagcggctgcttgcgctgcatataggtttcgatggcttcccacatacgggtgacctggccttccggctcgatccgcgccagcgaaccctgcttgaccttgccaccttcctggaccatttcgttgaacagtttcgggttggcgaaggtcgcgcgttgcgcggtcaggtggtcgccgcggtgggtcgcgtaagagttgaagtcctcttccggcagccccattttcgccaggtactcgccggccgcgctgtcgagcatgatggcgttggacggcgacaggtgatcggtggtgatgttgtccggcagcaccgccagcgggcgcatgccggtcaggctgcgcgccccggccagggcgccttcccagtacggcggacggcggatgtaggtgctcatctcacgccagtcgtacaacggctcgaccttgggcccggtatcttcgtgaatggcgaacatcgggatgtacaccttgcggaactgctccggtttcaccgaagccttgaccaccgcgtcgatctcttcgtcgctcggccagatgtccttgaggcggatttccttgccgttggcgtccaggcccaacacgtccttctcgatgtcgaaacggatggtcccggcaatcgcataagccaccaccagcggcggcgatgcgaggaacgcctgcttggcgtatggatggatgcgcccgtcgaagttgcggttgcccgaaagcaccgcggtggcatacaggtcgcggtcgatgatctctttctggatcaccgggtccagcgcgccggacatgccgttgcaggtggtgcaggcaaaggccacgacgccaaagcccaattgctccagttccctggtcaggccggcttcgtccaggtacatggcgacggtcttggaacccggcgccagcgacgacttgacccagggtttgcgggtcaggccgagcctgttggcgttgcgcgccagcaggccggcggcgatcacgttgcgcgggttgctggtattggtgcaactggtgatggccgcgatgatcaccgcgccatcgggcatttgccccggcacttcttcccactggccggcgatgcccttggccgccaggtcgctggtcgccacccgggcgtgggggttgctcgggcccgccatgttgcgcaccaccgaggacaggtcgaactgcaagccgcgctcatactggacatttttcaggctgtcggcccacaggccggcctgcttggcataggtctcgaccagctgcacttgctcgtcttcacgaccggtgagcttgaggtagtcgatggtctgctggtcgatgtagaacatcgccgcagtggcgccgtattccggggccatgttggagatggtcgcgcggtcgcccagggtcagcgccgcggcgccctcgccgaagaactccaggtaggcacccaccaccttctgcttgcgcaggaattcggtcagcgccagcaccatatcggtggcggtgatgcccggttgcagcttgccggtcagctcgacgccaacgatttccggcaggcgcatccaggacgcccggccgagcatcacgctttcggcttccaggccgccgacgccgatggcgatcacgcccagggcatccacgtgcggggtgtggctgtcggtgccgacgcaggtatcggggaaggccacgccatcgcgcgcctggatcaccggggacattttctccaggttgatctggtgcatgatgccgttgcccggcgggatcacgtcgacgttcttgaaggccttcttggtccagttgatgaagtggaaacggtcttcgttgcgccggtcttccacggcgcggttcttggcgaacgcatccgggtcgaagccaccgcactccaccgccagcgagtggtcgacgatcaactgggtcggcaccaccgggttgacctgggccgggtcgccaccttggtcggcgatggcatcgcgcaggccggccaggtccaccagggcggtctggccaagaatgtcgtggcacaccacgcgggccggaaaccacgggaagtcgaggtcgcgcttgcgctcgatcagttgcttcagggaagcgctcagggtcgccggatcgcagcgccgcaccaggttttccgcgagcacgcgcgaggtgtacggcaggctgtcgtaggcgtccgcctggatggcctcgacagccgcgcgggtgtcgaagtagtccagtcgggtaccgggtaacggtttacgaaattcagtgttcatcgtcaggactcggtcacggtgattgcaaaaggtggggctggcaccggcactgaaccgccctctgtaggagtgaagcttgctcgcgaagacggaatgacattcaacatctatgtcgaccgttacaccgctatcgcgagcaagctcgctcctacagggctttgggttcagccggtgacggcagccaccattcagcgacgttcgattggcacgaacttgcgctgttcgacgccgacgtactcggcgcttggacggatgatgcggttgttagcgcgctgttcgaacacgtgggcggcccagccggtcaggcgcgagcagacgaagatcggggtgaacagcttggtcgggatgcccatgaagtggtacgccgaggcatggtagaaatcggcgttggggaacagcttcttctgctcccacatggtcttgtcgatggcttcggaaaccgggaacagaaccttgtcgcccacctcgacggcgagctttttcgaccagcccttgatcacctcgttgcgcgggtcgttgtctttgtagatcgcgtggccgaagcccatgatcttgtccttgcgctcgagcatgcccagggtgcccttgatcgcctcttccggcgaagcaaagcgctcgatcatctccatcgccgcctcgttggcgccgccgtgcagcgggccgcgcagcgaaccgatggccgcggtgacacaggagtacaagtccgacagggtcgaggcacagacccgggcagtgaaggtcgaggcgttgaattcgtgctcggcatagaggatcagcgacacgttcatcactttggtgtgcagctcgctcggtttcttgccgtgcagcaggtgcaggaagtggctgccgatgcacggctcgtcggtcacgcaatcgatgcgcttgccgtcgtggctgaagcggtaccagtaacacatgatcgccgggaacgcggccagcaggcggtcggtgacgtcatgttgccgggagaagtcctgttccggctcgatattgccgaggaacgagcaaccggtgcgcatcacatccatcggatgggcgtcggccgggatgcgctccagcacttctttcagcgcctgcggcaggtcgcgcagcttgctcagcttctgggtgtaggcgtccagttgcgcctgggtcggcagctcgccgtacagcagcaggtaggccacttcctcgaactgcgcgtcggccgccagttcgcgtacgtcgtaaccccggtaggtcagcccggcaccggcctggcccacggtcgacaaggcagtctgtccggccacctggccacgcaggccagcgccactcaatacttttgcttcggccattgctctctccaatcttgaatttgttagggaatcggcaacttcatgggtcgggactcaccccgacactgtaggagcgagcttgctcgcgatagcgctataacggtcgacatcgatgtcgaggggcaatccgtcatcgcgagcaagctcgctcctacaaaggttggttcaacccttcttctgggcgaacagcgcatcgagcttctgctcgaaggtgtggtagtcgatgcggtcgtacagctccatgcgggtctgcatggtgtcgatcacgttctgctgggtaccgtcgcgacggatcgcggtgtagacgttttccgccgccttgttcatggcgcggaatgccgacagtgggtacagcaccagggaaacatccacggatttcagttgctcggtggtgtacagcggcgtggcgccgaactcggtgatgttggccaggatcggcgctttcacccggctggcgaaaatcttgtacatctccagctcagtgatggcttccgggaacaccatgtcggcgccggcctcgatgcaggcggcggcgcggtccagggccgactccagcccctccaccgccagggcgtcggtgcgggccatgatcacgaagctgtcgtcggtgcgggcatccaccgcggccttgatgcggtcgaccatttcctgctgggagacgatctccttgttcggacggtggccgcagcgcttggcgccgacctggtcctcgatatgaatcgccgccgcgccgaacttgatcatcgacttgacggtgcgcgccacgttgaacgccgacgaaccgaaaccggtgtccacgtccaccagcagcggcaggtcgcagacgtcggtgatgcggcgcacgtcggtcagcacgtcatccagcccggtgatgcccaggtccggcacgccgagggagccagccgccaccccgccaccagacaggtagatcgccttgaacccggcgcgcttggccagcagcgcatggttggcattgatggcgccgaccacctgcaacggtcgttcgctggcgaccgcatcgcgaaagcgctggcctggagtgctcttgttgttggaactcatgactcacctctctagggcgcgcactctggaaagtgacgggcaatgttgcgtttggaagcgccgatgtgacggcgcatcaacaactcggccagttcgccgtcgcgatcggcaatggcatcgagaatccggtggtgctcggcgaacgcctggtgcgggcgattgggcgtggcggaaaactggatgcgatacatgcgcaccagttggtacagctcgccgcagagcatctgcgtgagggtgcggttgcccgcgccctggatgatccggtaatggaagtcgaaatcgccttcctgctggtagtagccgaccccggcctggaacgccgcgtcgcgctcatgggtatcgaggacccggcgcagctcgtcgatttcctcgttggtcatgcgctcggcggccaggcggcaggccatgccttccagggattcgcggatttcatagagttcgatcagctcggcatggctcagggacaccacccgcgccccgacatggggcacccgcaccagcaggcgctggccttccaggcggtggatcgcctcgcgcagcgggccacggctgatgccgtaggtgcgcgccagttccggctcggaaatcttgctgcccggggcgatctcgcccttgacgatggccgcctgaatgcgtctgaagacgttttcggacaaggtttccgaatcgtcctgcgtcacggcggggggatcgagctgatccagcatattgtcgacaccttgaaaatcaatgcgacaaaaactagccaatacaaccgatgcagtcaaaggaaaaatagatattgtcgacaatcgtctaataaccctttgcaccaaaccggcacaaaagcacccgccccgccgctggcgccataaaaccagcatgctagaatgccgcccgcatttgcctgtcacattaataaggcagcacacgagggagcttgcgcagcaatgccagtcgccttgaactgaagaacccatgcaacgcaccaggatctatgagactcaaggccttctccatactgttctgcctgctcggcctgccgggcctgagtgccgccgccggcaagaccgtttacggtctgaatgaatacgccagactgtccgggatcgacctggaagtcgccgccaagctcgacaccggcgccaagaccgcctccctcagtgcccgcgatatcaagcgcttcaagcgcaatggcgagtcctgggtacgcttctacctggccatcgacgccgctcattcccaccccatcgaacgtccgctggcccgcgtcagcaagatcaagcgccgcgccggcgactacgaccccgatgaggaaaacaacaagaagtacaccgcgcgcccggtcatcgagctggatatctgcatgggcggagccctgcgcagcatagaagtgaacttgaccgaccgcagtgcattccaatacccgctcttgatcggttccgaagcgctcaagcgcttcgatgcactggtcgaccccagtcttaaatacgctgctggcaaacctgcctgcgccaccgacgctcataccgcagagtaattccaatgcgctctcttaccctccatctgaaaatcctgatcgccatcctggtggtgctgggcatttcgatcacggcctatcagattttcgtgctcggcatcccggtgaccgaagacgccaccgacgacctgtggaacatcgacgccaaggtggagttcgtcgccaacgccaaggacccgatcaagatccagatgttcgtgccgcccctgagccgcgactacgtcagcctgaacgagagcttcatctccaataactacggggtggcggtgaaccgcgtcgacggcaaccgcaaggtcacctggtcggcccgccgcgccaagggcaaccagaccctctactaccgcctggtgctgaccaagcgctacaccgcggaaaaagccaagatcaagggcccgaccttccgcgacagcatcgccgtcgaaggcccggaaaagatcgccgccgaagccctgctcgcgccgatccgccagcattcggccgacgtcgagaccttcatcagcgaagccatcaagcgggtcaacaacaccaacgacgacaacgccaagatgctcctggcgggcgatccgtcgccggcgcacaaggccaagatcgtcgacctgctgctgtccatcgcccacgtgccgatggaaaaggtccacaccattcgcctggtggccgaccagccgcaggccccggaactgtggctgcgcagcttcaacggtaccgactggctgtacttcaacccggaaaccggcgaacagggactgcccagcgaccgcctgctgtggtggatcggtgacgacaacctgatcaccgtcgatggcggcaagaaagccaccgtcaccttcagcctgaacaacagcgaaatgaacgccattcgcctggccaagctgaccgacgagaacaccgacgccaacttcctcgaatactcgctgtacggcctgccgctgcagacccagcagaccttcatgatcatggtgatgatcccgatcggcgtgctggtgatcctggtgctgcgtaacctgatcggcctgcagaccctgggtaccttcaccccggtgctgatcgccctggccttccgcgaaacccagctgggcttcggtatcgtgctgttcacggtgatcaccgcgctcgggctgtcgctcaggtcctacctggaacacctgaagctgcagatgctgccgaggctgtcggtggtgctgaccttcgtcgtggtgctgatcgccgccatcagcctgttcagccacaagctcggcctggaacgcggcctatcggtggccctgttcccgatggtgatcctgaccatgaccatcgaacgcctgtcgatcacctgggaagaacggggcgccggccatgcgatgaaagtcgccatcggcacgctgttcgccgcctccctggcgcacctgatcatgagcgtgccggagctggtctacttcgtcttcaccttcccggcgatgctgctgattctggtgggcttcatgctggcaatgggtcgctaccgcggctaccgcctgaccgagctgatccgtttcaaagccttcgtcaaggctgattcgtaatgttcggcctgtggaagacctggaaggccctggaagcccggggcatcatggggatcaatcggcgtaacgcggactacgtgctcaagtacaacaagcgcagcctgtacccgatcgtcgacgacaagatcattaccaaggaacgcgcgatcgaggccggcatccatgtgccggaactgtacggcgtgatctccaccgagaaggaaatcgacaagctcgacgagatcatcggcgggcgtaacgacttcgtgatcaagccggcgcaaggcgccggcggcgacggcatcctggtgatcgccgaccgtttcgaagggcgctaccgcacggtatcgggcaagatcatcagccatgaggaaatcgagcaccagatttccagtatcctcaccggcctctattccctgggcggccaccgtgaccgggcgctgatcgaataccgggtgaccccggaccagatcttcaagagcatcagctacgaaggcgtgccggacatccgcatcatcgtgctcatgggttacccggtgatggccatgctgcgtctgccgacccgccagtccggcggcaaggccaacctgcaccagggcgccatcggcgtcggcgtcgacctggccaccggcctgaccctgcgcggcacctggctgaacaacatcatcaccaagcacccggacaccaccaacgcggtggacggcgtgcaactgccctactgggacggcttcatgaagctggcggccggctgttacgagctgtgcggcctgggctacatcggggtcgacatggtgctggaccaggaaaagggcccgctgatcctcgagctcaacgcccgccccggcctgaacatccagatcgccaacgactgcggcctgacccagcgcacccacgcggtcgaagcgcacctggaagaactgaaagcccgcggcatcagcgaaaccgtcgagcagcgcgtgcagtttgcccaggacctgttcggccatatcccggcggtggaaggctgaaccacagcaacggaaaaccctgtagccgctgccgtaggctgcgcccgaccgcgaagcgggcgccgctttcgacatcgccgaggaccttcgatcctttcgcagccttcggcagcggctacagggtatgcggcgaggcgtgcgatgcgtcgtaaaccgggcaatccctgccatccccactaggagcaaatccctgaggggactacaatcgccagccgcgctcctccgatggctgatccgccccgcatgtcgacctgttccgtacacccgctgccctatcgcaccaaccccgccgagtatttcgcggcgatccgccatgcccctggcgccgtcctgctcgacagcggccggcccaatgccgagcgcggccgctacgacctgctcagcgcctggccacgggcccagttggccgtcctcaaggacgaaagcggcgaagatttcctgcaacgcctgcggctcaacctggaccaattgggccaggcggcgatcccggcgccttaccagttgcctttcgccggcgggctgatcggctacctgagctacgacttcggacgccatctggaacgcctgcccagccaggccctggatgacctgcaactgcccgatgcgcgcttcggcctctacgactgggcgctgatcagcgaccatcagcagcgcaccagccaactggtattccaccccgcgcttgccgccagcgaacgccagcgcctgatcgccctgttcggccaggcgccggccggcgcccacgacagcttcaagctcagcgggccgatgctgcctgacctcagcgccgcgcagtatcaacaggcgttcgagcgcatccaggcgtacatccaggccggcgactgctatcaggtcaacttcgcccagcgctttcgcgcgccctgcgctggcgatccgtgggttgcctactgcgcgctgcgcgcggcctgcccgacgcctttttccgggttccagagcctgccggaaggtggcgcggtgctgagcctgtcgccggagcgcttcgtgcggatcagtgagcgccaggtggaaacccggccgatcaagggcacccgcccacgcagccaggatgctgccgaagacgcggcgaacgccgccgagctgctggccagccccaaggaccgcgcggaaaacctgatgatcgtcgacctgctgcgcaacgacctgggccgcacctgccgcatcggctcagtgcgggtaccggagctgttcagcctggaaagctaccccaacgtgcatcacctggtgagcagcgtcaccggcgagctggcggacgacaaggacgccctggacctgatcgccggcagcttccccggcggctcgatcaccggcgcgccgaagatccgcgcgatgcagatcatcgacgagctggagccgacccggcgcgggctgtattgcggttcgctgctgtacctggacgtgcgtggcgagatggacagctcgatcgccatccgcagcctgctggtcaaggatgggcaaatctgctgctggggcggtggtgggattgtcgcggactcggactggcaggccgagtatcaggagtccatcaccaaggtgaaggtcctgctagagacgttgcagaacctctgatcatgcccctgtagccgctgccgaaggctgcgatagggccgcaggcccttcagcgttggggaagacgccgcggccgtaccggccgatcgcagccttcggcagcggctacaggtacagcgttacaagctcaattcgcgattcgaggccttgaggaattcctgcttcagctcggcaaagctgtgcaccgccgggaactgcggaaactcgcggatcacgttgtccggggcatggaacagaatgccggcatcggcctcgccgagcatgctggtgtcgttgtacgaatcccccgccgcaatcacccggtagtacaggctcttgaaggccagcaccgactggcgcttggggtctttctggcgcagctggtaaccggtcacccggccgctgtcgtcggtgaccaggcggtggcacagcagcgtgggaaagcccagctggcgcatcagcggctgggaaaactcatagaaggtgtcggacagaatcaccacctggaaacgctcgcgcaaccagtcgacgaactcgatggcgccgtccagcggcttgagggtggcgatcacctcctgaatgtccgagagcttcaggccgtgctcgtcgagaatccgcaggcgctgcttcatcagcacgtcgtaatcgggaatatcccgggtggtcgccttgagggattcaatcccggttttttcggcaaaggcgatccagatttccgggaccagtacaccttccaggtcgagacaggcaatttccacaggacactcccatttgtattggttattcgagcgagcaaaaggactgccgaactctagcgattcgccctggcccacgcaacgcaaggagcgcgccagccgagggcggattttgttaccatcgccagtatctagagcgctcagcgccaccgacctgtaggaaaccgccctgatgagcccatcgttcaatgtcgctgaactcgccgcgacctatgcccaaaaatccgcccaggacattctcaagctggcattcgccgagttcggtgatgacctgtggatctctttcagtggtgccgaggatgtggtgctggtggacatggcctggaagctgaacaagaacgtcaaggtgttcagcctcgacaccgggcgcctgcacccggaaacctaccgcttcatcgagcaggtacgcgagcactacaagatcgacatcgaagtggtttcgccggaccacgccaagctcgaacccttcgtcaaggaaaaaggcctgttcagcttctataaggatggccacggcgagtgctgcggcatccgcaagatcgagccactgcgccgcaagctgtccaccgtcagcgcctgggccaccggccagcgccgcgaccagagcccgggtacccgcagccaggtggcggtactggagatcgacagcgccttctccaccccggaacgcaccctgtacaaattcaatccgctggcgcagatgaccagcgaagagatctggggttacatccgcatgctcgagctgccgtacaacagcctgcacgagcgtggtttcatcagcatcggctgcgagccttgcactcgcccggtgctgcctaaccagcacgagcgcgaaggccgctggtggtgggaagaagccacgcagaaggaatgtggcctgcacgccggcaatatcatcagcaagggctaagcccccaattcctctttcttctgtaggagcgaagctggctcgcgagacggtggatctgacacaccgcttcgcgagccagcttcgctcctacagaagcccttccttccggtaaaaattttgtacacataagtgtcaccgcaggtgccatttttgtgtgcactttatgcctctacgccccaaaaagttacaccctcctccctgggccattctccaccgcgctcacaccctaccccctcgaaaaataaatacctgttcgaacggtcaatttataacttcgcaatttcagtaatttagaaattattaagaacaaaccgaaattatcggtcgcttgcttagattgggatctggcacggaagtggcttaattcgcctagcattttgtatacaacttaaataaaaaatacatacactttatatccgcaagccgggttcccgaatccgcctgcagatgcccagaacccagtgattcccggactgcgccgaagactgccgagccttgcgctcaagcacagtcagcgcggatccgcgatcaggagcctgccggaatgcgtaccagtccttccaataacatcgcactggatttgccctcttcccatacccacgccaacctcgaccccagcatcgcccgcggcaccgcttcgccggtcgacctcagcccgcgcctgcacaaccgcgacctggcgccgaccaaggtcgaaggccggcgctggggtggctacagcatctttgcgctgtggaccaatgacgtgcacaacatcgccaattactctttcgccatcggcctgtacgccctgggcctgggcggctggcagatcctcctgtccctggggatcggcgcggcgctggtgtacttcttcatgaacctgtccggctacatgggccagaagaccggcgtgccctttccggtgatcagccgtatcagcttcggcatccatggcgcgcagattccggcgctgatccgcgcggtgatcgccatcgcctggttcggcatccagacctacctggcctcggtggtgttccgggtattgctcacggccatccaccccggcttcgccgactacgaccacaactcgatcctcggcctgtcgagcctgggctgggtgtgtttcgtggcgatctggctggtgcagctggcgatcctcgcctacggcatggagatggtccggcgctatgaggcctttgccggtccggtgatcctggtgaccgttgccgccctcgccgcctggatgtacatccaggccaacgccagcatcgcctggtcgatccgcgagcccttgagcggtggcgaaatgtggcgccagatcttcgccggcggcgcgctgtggctggcgatctacggcacgctgatcctcaacttctgcgatttcgcccgctcctcgccctgccgccggaccatcaaggtcggcaacttctggggcctgccggtgaacatcctggtgttcgcggccatcaccgtgttgctctgcggcgcgcagtttcagatcaacggcaagatcatcgaaagcccgaccgaaatcatcgcctcgatccccaacaccttctttctggtactcggttgcctggcattcctgatcgtcaccgtggcggtgaacatcatggccaacttcatcgccccggccttcgtgctcagcaacctggcgccgaaatacctgaccttccgccgcgccgggctgatcagcgcgactatcgcggtgctgatcctgccgtggaacctctacaacagcccgctggtgatcgtgtacttcctgtccgggctcggtgccctgctggggccgctgtacggggtgatcatggttgactactggctgctgcgcaaaggtcggatcaacgtgcccgagctgtacagcgagcacccgcaaggcgcgtatttctacagccgcggggtcaacctgcgggcggtggcggcattcgttccctcggcgctgatcgccattgtcctggccctggtgccggggtttgccagcgtctcgcccttctcctggctgatcggcgccggcattgccggcttgctgtacctgatcgtcgccaaacgccagccctactatgcggatgtcagcggcgaatccatcgccgtcgataacgtcagccactaaccttgaacggcccgcctgcggcgggccccgaatgcctaacgataaggacagcacatgcgaattctcgtggtcaacgtcaacaccaccgactccatcacccaggccatcgcccgccaggcccaggccgtggccgcgcccggcaccgaaatcatcggcctgaccccacacttcggcgccgactccatcgaaggcaacttcgaaagctacctggccgccatcgccgtcatggaccgcgtgctgtcctacgaccagccctacgacgcggtgatccaggccggttatggcgagcacggccgcgaaggcctgcaggagctgctcaacgtgccggtggtggacatcacagacgccggcgccagcaccgcgatgttcctcggccacgcctattcggtggtgacgaccctggatcgcaccgtgccgctgatcgaggaccgcctgaaactctccggcctgtacgaccgctgcgcctcggttcgggccagcggcctggcagtgctggagctggaagaggacccggcgcgtgccctggaagccatcgtgcgccaggccgaactggcggtcagcgaagacaaggccgaggtgatctgcctgggctgtggcggcatggccggcctggacgagcagatccgccagcgcaccggcgtaccggtggtggacggcgtgactgccgcggtgaccatcgccgaatccctggtgcgcctggggctgtccacctccaaggtacgcacctacgccacgccacggccgaagaccatcatcggctggccagggcgcttcgggcgctgagccttcgcttgtcgcgagcaagcccgcctctattagggaagcgggtttgcacgcctcttcaaaccgcgctgaagcgttgctccaggccctgctcggcgaactgctcgatcacgaagtcgacgaaggcccgggtcttgcccggcagcagtttgtgctcggcgtaatagatcgagatgttgccgtcgtcgacgtaccagtccggcaatacccgcaccagggtgccggcgttcaagtaaccgacggcgaacggcatgctcaccagggccacccccaggccctgggcggcagcggcgcaggccgcttccgaatcactcatggtcatccgcgccttgaggttcagcgggctttgctgccgggtgcggctggtcagggcccaggagcgcacccgcccggtctgtggcgagcggatcaggatgccttcgcaatattgcaaatcctcgggctgctcgaccgccgcgcagcgcgccagatagtccggcgaggccaccaggatgcggtgagccgaggtcagccgtcgcgccaccaccccctggggcagctcaaagccgccgccgatcgccgcgtcgaaaccctggccgatcaggtccacctggcgattatcgaaatgccagtccgggctgatctctgggaaacgccgcaggaattcgccgagcatgggcacgatgtacagccgtccgaacaccgtgcccatgctgactttcagggtgcccgccgggcgcccttcggcgctggccaggttggccacggcgttctggatggtgtacaggctggcgctgacctcgccaagaaacagtttgccggcctcggtcagggtcagactgcgggtgctgcgctgaaacagccggaccccgagccgagcctcgagcttggccacgcttttacccaccgcggcgggggtcaggctcaagcgtcgcgcggcttcggcaaagctgccgacttcggcgctgcgcacaaagcattcgatgctgctgaaggtttccatggcgcctcactataaacttctgatttatacagactagagcgattcctatctacacagcacctaatccgaagtcgatactcgactccaaccacaaggcagcccgccttggactttttggagaacgacatgaccactcaatccctcagcggcaaagtagccctggttcaaggcggttcccgcggcatcggcgcggccatcgtgcaacgcctcgcggccgaaggcgccgccgtcgccttcacctatgtcagctctaccaccaaggccgaagccttgcaggacagcatcaccgccgctggcggcaaggccctggcgatcctcgccgacagcgccgatgccgtagccatccgccaggcggtcgagagcacggtcgaaacctttggtcgcctggacatcctggtcaacaacgccggcgtcctggccatcggcccgctggaagacttcaagctggaagatttcgaccgaaccctggccatcaacatccgcagtgtgttcgtcgccacccaggaagcggctcggcatatgggcgaaggctcgcgcatcatcaacatcggcagtaccaatgccgaacgcatgccttttgccggtggcggtacctatgccatgagcaagtcggccctggtcggcctgaccaaaggcctggcccgcgacctcggcccacggggcatcaccatcaacaatgtgcagcccggcccggtcgacaccgacatgaacccggcccacggcgacttcgccgaaagcctgatcccgctgatggccatcgggcgctacggccacgcgaaagaaatcgccagcttcgtggcttacctggcaggcccggaagcgggttacatcaccggcgccagtctgacaatcgacggcggcttcagcgcctgattcctgtgcccatgaaaaacgccgggccaccctcatcaggtggcccggcgtttttgtagccgctgccgcaggctgcgatcgactccgcagaaggcgccgcacttgagaccgctgaagccctggcgggcttatcgcggcctgcggcagcggctacaggttcaggaccacgccaactgcggcaaaccacaggccgccggctggaagcccttcagcgaacgcaggatggcatcggcatgggcgtacttggcgtccgccatcgccggatcgggaatggcgatcgcggtcatccccgccgccttcgccgcggtgacaccaaagggcgaatcctcgaacaccaggcaatccccgggcgcgacacccaggcgccgcgcggcggtaaggaagatgtccggcgccggcttggccgcgcccacttccgggtcgtcggcggtgactatggtgtcgaacagcgcgaaccagtcgccgtgcaaggtggttttctgggcgaaagactggcgcgaagaactggtgcccacggcaatcggcacgttattggccttgaggtgctgcaccagctcctgcgcgcccggcatcgccagcgcccggggaaagcgttcgcgcatcagcggctcgcgaatcaccaggaactcctcgggcgtgatcggcagatccagggcttgcaccacataacgggccagatccgcggcgccacgaccgatgatgttctgcttgatcgtccaatcgaaggtgcggccataacgatcggcgatgatctgcgtcacctcggtgtagatgccttcggtgtccagcagcaaaccgtccatatcgaaaatcacggccttgatcgggccgacgtcattcaactgtgcattcatcgcatctgatccgttaacaaaaaacatcccggggagcggctcaggtacggccagtttcttgcccgattaaagggttcagcagcatagccgcggcagatgacggggagcaaccgcgggtcagcgtgcaggcagacaaaagcccggacaggccgggctcgctggtctcgacatcatgagtgaacaaagcacgctagcgtcccgcccgtccgctgccgcctcctggccccccggtgccaccgcccgcgctgccggttccaccaccggcaccgccgccgcccatgatggaaccattgacgccagtggagcccatgccgccgccctggccggaagagccgcgcgatttatcgacccgtgaacggctgtccatgacacccacaccattcccgcccagggctcctggtcgcagcatgagatcgttgccggaaccaccctcgaacgaccgcagcggaggatcggccggggctcgtccgtcagcggattctgccaggctggagaaacagaaaatcgacaccaaggcgaccaacaccaggctcagcagttttgcacggctcacgacgcgcctcccggggcggggcgccgcttgcccctggccgccttgcgctgcggctcgggtcgagacagctcctgttcggcgttggcatccgggaggatctgctcgggagtcagcgcatccgtgggggaaggcagcggatattcgggcgtgtcatcccggtcgataggtttcggatcatgcttcataggcacctcacaccgctcatgccggcgtgctggaagcagacttcacgggcccttttcctccgactcgcctgcctcatcgtcatcgctcagcggcaccagggcgtcatccatcaacgagcccgggtcttcattgcctggatcgttgaccaagggcacgcccgaagcgtcctgttctttcttgcctagggtttctggaatcatggcaaacctcgtcgacacagtgtgtccatcattgaattcgagggactggaacgctattcgttcccataaaaaagcccggcacgaggccgggcttttttgcgcactgctgcagaatcagtcgtgcttgtgcttgtgtttattcttgtgctttctgccgccggagtgatggtcatcgtcacccatgctgctgcccaaagcgccaccggccgcgccgcccaggcctgcgccgatggtcgagccagtgctgccgcccagcttgttgccgatcaccgaaccgccggccgaacccaggccgccaccgatggccgcttcggtccgactgcccttacgggcaccgaccgcactgccggcagcgccgccaaggcccgcacccaccgcggcgcccgtgctgccgccaatctgttgtcccaccacattgcccagcgcgccacccaaaccgccgccgaccgcagcagtgccatcaccggcggccatcgcaccttgagcagccagaagccccaaaaccagagcaggcagtgttaaacgcatgatgtaaacctcgaaaaagatgctggagagtcattctaaagcggtgtctgactaaagctgagcggcgacagcagaacgctgtgatccttttagtcacagtcttggaccgtttttgcgcaaagagttttcagccaggcaaaaaaaagcccgctggggagacgggctaataggatttgctttaacggatgagtcgagcctacgcagtcgtttgtgaataaagtgtgaaaaccccgctaccctgtgcaacggataagacgaaaggtccaacttcattcaaatcaatcgcggcggcccattgttcaggtaacaaaaaccccgcccggaagcggggtcgttcggtatgtatgaaggctaccttctcttaggaagcgccgctttcgggaaaaactttgtctgggtcaccctgggtaacgcactggccctggtcttgcctaccgacgccttggccggtggctcgctgtcaaacgctgcctgaccgcagcgcaccaggttgttgattgggaactcatccccgttgtcctcgatataaggatcgctcatctccctgctccctccaacaaccggtcgataccggcaagcacctgactgcctagaaaatatcgaccgtcacggcgtttcagactagccggtcatttaaggacttgtagttcacaagagaaaagaccgacgaatggcccaagttggagttcttcgtccaagggtgtggatcgtcgctgaaaaaggaactgatggcttgcatcagctcctttttccgggtgtatttcacctagaccttacgagcgtagttgctggccccgaaccagtcgaccaccaccacggtttcatcccccaccacccaggcgtcgtgacctttaggcagggaggtgatatcacccggcccggcgatgatttcggtgccgtcatccatcaggatcgccagcctgccggccacgtgatactgaaagtgcggtgcctggcaactcggtgtctgcgccagcggtttaatgtcgttcgaccagcgccagcccggcttgaaagtgaagcgccccacttcacactgaccgatcttcaggatctctgccttgccattggaaaactcgcgggtctcatccggttcggagaaggatttatgctcggtgacctgttcgtgcgtggacatgatggtgtcctcgattgagtagctgcaaagcctgccgacgccggcaatatcatccccgcgcccgcagacaaccagcatcgccccactcgatgcgcctgaccattctagacctgaaagcgtggggtgcccgggacaaacgctaaacgtacggctgcccatcaaagccccgaggcaggcgctgcaatccggccatggccgtcagccgttgggtccaggctgcacgccagtcgcttgccgcgtgttctgccttggctttgcgcgccgctcgacgtgccgcattgcgctgattcttgcgggcttccttgaacacctcggtattgcggcaactgcggcatttgacccgcgccggttcggtgctggatatgagattggaacccttgtggccgcaggcaagatgcccggcgaccttgaagtgaatgaccattgtgcgtctcctcgtagccattacggagcacagaaaaccgcacgctgatgcccgcctgatatcggcggaaaacctcaccctcaaggtgacttgaccgccaagcttcgcaggggtaacaaagccaaagaccactcaagtatccagcgtgatcgataccttgctggagcaaccttggctgttgcgaactcgtaatggttttgaccgtcgcggaagaacagcgttcggcgaaagaggaatcagcgctgccgggcaaaccgccgcttcaacagctcccccagaaagcacaacccatggacttttcaaggagatcaggggttggagcacatcaatacagtggggaccgagggatactcccgatacagtccgctctaaaaaaataccagttaaacaagtatgaatatccggaaaaaatcaaattggcttgattctcatgaagtccttgaagctaattatttccccaacccactgcgaaatcatggacgtcattgccttgtgcacagcgccgtctccccaggtattgccatattcagtcgcagctgaggcctcaggaacaaagaatagtcggaaccctctgtgaaacattgggatcattccagtcggcatcccaatcacacacatattcgatgcaaaaccagagtatataagcgtgtcgataccagccgacttcaagtagacctcaaactttctgtcatccatatctgagtgataaagaacatcgactttaccggcatcgacaagcacttgcagattggggttgattcgtgcggcataccccaaatttatagtctggggatcgttggttatgacaacaaccttaagccccatcgctatagagtgcttggccagaggaacaagtctttgagaaaacacttttttgtaatatttattcatctttggtgagccggtgtcctcccacggatccatcaccaccaaagcagtcttgtctttagagagggctcgctgaaactcatacttcccctccttcaccttataaaaagcctgtccattctttcgctcaggaatgagaccacccgccttatccagtgcaaagtgggatttcctccaggtctttatcaagtaatctgactttacatggactgactttacagaatctgaaattacctgctctgaatgcacagactccgactcggaatacgctacagacgatccaatgacaccgaagaaaaaacacaaaaacaactgtaagttacgcaatttgcctccaaaaaaatatataaaaattaatacttacaaactctctgaaaccattccaaacagactatcagctagaacaactctcatcactgttgagggacacagatgatgtatcaccgtcagatcaagctcaaggccatcggtgcaaaccccctcatttatattccgcccctgaggccaccttagcctgccgcaaggcaatgaaagcctgtaccgggcttgagcaggtaatagtgggattcctgcccggctggatggataaagcggcttcgacgaacgaggtctaccgggaattcgcatggccgctgtggtattttcacgcccctccgagtactgatacgtcgaaaatgaaaaattccatcctgaaaattccattgaatcgaagcagatcacagaatatcgatgcgcttcgtttcttgttagctacctgggtggtaataacccatcttgccccttggattgtggccattcagggctctgcagccatccctgagagcctcatctggctgacacgtgaactcgaaagcctatttcaaggaagtggagaaacccaccccgcggtactgggtttcattgtgctgagtggttattgcattcatagaaacggcctgcgctcacaccaagacggcctgttttcttatgcagttcgcagattcttccggatatatccagtcttcctcattgctgcgcttttcgggttcttgatgttctatattgcatcccagataagccccgactctgtgacttcggtatctggtaccgctgaactttcattcaataacatgcttagaaagcttcttaccaccgaagttatctatcctttcgattattacccatcaatccaagggaacggaccattacaaactgttgccgccgaaatgtggctgtatgcgatctatccactagcgctgttagttattggaaaactctcagatcgctcatggtgggttgtggtaatcatttgctggatagcctctattactatcaactctttcattcctgagtggcgcggctggtcattcaacgccagccttattggattcataccctactggtggctgggcctgaagttcactgaccaaaatttctgcagattcatgaatcgaattgtcattcttcccgtgattatctggttgcttatcaccttgttcgagaaggacctacagcaatatggacagctcttcgctgctgttcgacaactgatgtttgccctgtgcttcgcaagcctgatatcgatcctggataaaaaacatagtgtatccataaagccattgagcgcagtaggatcggccggttatagcatttatgctttccatgcccccattgtctacgtaatggtgctgtgtggtgctccatggtggctgattggtctcagtgccgtcgcgataggtgtagccgcatttcatttaattgaaaaaccgttcattgcggttggcaagcgcctctccacctctcgcaccacattgctgcagtcacgtagttcagaccccgtctaacggctccagacctgagacctgctgcgccatagagccctgcatacgtcttcaccttaagttgcggatttacgccatggtggtttcaccatggccactccccagcccattcctgagagcgatgtattctcgagcagctggatcactgacaggcataccgctggcaatatgatccttcagactcgcgagtcaggatcaacaaagcccctcaccgccatccaaatacttttcagacactagaaagcacaagacccctggtttctcgaggaaaccaggggtcttgcgtagatcgaatatggcggttgaggagggattcgaaccctcgatacagtttcctgtatacacactttccaggcgtgctccttaagccactcggacacccaaccgtgtctcgtcaaaccgattcagtctgtcgaggcgcgctaatgtagtcgaaagcttttctgatggcaaaggtttttttgagaattttcatgcgcttaagacatttcttcggattgcggcactgcgctggcatcagcgccatggcaaaccggccaatctctggcctggctggcagctatataagagggccgatccgcgccccaggtggccggctacgcttgtcaggccagaaagagctgactcaccagtcagtcacagcgctttacctgacctgtgaccgtgagtaacgtctgccccacttcaatacaaggaattgcgtcatgagtgagttgatttcttaccacctcgaagacggtatcgcgaccctgaccttgagcaatggcaaggtcaatgccatttccccggacgtgattgccgccttcaatgccgcgctggaccaggccgtcaccgatcgcgcggtggtgatcatcaccgggcagcccggtattctgtcgggcggctacgacctgaaagtgatgaccgccggccctaaagaagccgtgagcctggtgacctcggggtcgaccctggcccgtcgcctgctgtcgcaccccttccccgtcatcgtcgcctgccctgggcacgccgtggccaagggcgcgttcctgctgctgtccgcggactaccgcatcggcgtcgaaggcccgttcagcatcggcctgaacgaagtgcagatcggcatgaccatgcaccacgccggcatcgagctggcccgtgaccgcctgcgtaaatccgcgctgcaccgctcggtgatcaatggcgagatgttcgacccgcaaggcgcggtggatgccggcttcctcgataaggtggtgagcgtcgaggagctacaaggcgccgccctggccgccgcgcgtcaactgaagaagatcaacatgaccgcccacaagaacaccaagctgaaagtgcgcaaggcgctgctggaaaccctggacaacgcgatcatcctcgatcaggaacacctgggctgaaggctggacccaccgcccacagcccgacccgcgcgtcgggcttttttatggttcttcacggaatcccgggaaacacagaaacaagaacgccgatttgattgatgatgttcgtgcgagcaaacacatctaacaaaccggcgttcttatgcgtgatattaatactttccttcccttttgggagggcttttctgtcgtcacgatcaagcctgatggtgacgcgctccagatcgatctgattccccacgccacccgattcccttcctgtggcggctgccaaaaactctgttcaaccacgcatgagtactgccagcgagtcatccgcgatctgcccattcttggccgagcagtgcgcctcagcgttttgcttcggcgtgtcggctgtcgggactgtggcaaacgcatggaggccgtcagttggctggatcgctatgcccgcatgacgcgccgcctggccgatgcggtcattcaggcctgcgagcgccttcccacgctacacgtggcccaactgttcgggttgcattgggacagcgttcgcttgctgggaacgtcgcgccttgcaagcggcattgagtgttttgccaaaggcgcagccacagcgcttggtcatggacgaatttgccctgttcaaaggtcatcgttacgccagcgtagtgctggacgccgatacccggcgagtgctgtggattggcgaaggccgcagccgggcggcagtcagaccctttttcgaagagctggggtcagagggttgcgctcgcatcgaagcggtggcgatggacatgaacactgcctttgacctggaggttcgtcagcactgcccaaaagcgcgcgtggtctacgacctcttccatgtggtggccaagtatggtcgagaggtgattgatcgagtccgcgtcgatgaagcgaatcggctacgtcacgacaagcctgcccgcacggtcatcaagcaggcgcgatggctgttgctgcgcaatcggcagaacctgaaaacgccggaacaacaagtccgcctggaggatctgctggcggccaaccaagcgttgatgacggtctatttgatgaaggctgaactcaaaacgctttggacaccgagcaccgcctggggctggcgatcagcctggcgacaatggctgcgccatgcgcatgaaagcgacataccgcctctgatccagtttgccaaacgactgaagggttactggcggggcatcgtcagccgggtgcgctggccaatgcatacgggccagttggaaggcatcaacaatcgaatcaaggtcatcaagcggatggcgtacggttaccgggacagcgaattctttttcatgaagatcaagagcgtctttcccggtaatccgtgaagaaccttttttatgcccgcaccgcgagaaagactggcgcgccgctctagttcgccactgagcaaagagtcggaaacatgcgcttaaacatcggccatcttccccttctatacaggtaattgccgaaaacagtgcacatccgtacactgcgccaccttttgtccccggtgggcctgtagatgctgtatctgtttcgtatgttattgatgggcctgcattttgttgcagcgggaattctcggcgtggggctggggctgtgccgcccgttcaacccggataacagccgcctgtgcgcgcgtttgtatgccttgccagccatgtgcatcctgcgcctgcgggtcaaagccgaagtcgggccgctgatggacaagcccaagagctgcgtgatcatcgccaaccaccagtccaactacgacctgttcgtgttcggcaacgtggtgccccagcgcaccgtgtgcatcggtaaaaagagcctgaaatgggtgccgctgttcggccagttgttctggctggcgggcaatgtgttgatcgaccgtggcaacgcgcacaaggcgcgccgctcgatgctgaccaccacccacaccctgcaacacaaggacacctcgatctgggtgttcccggaaggcacccgcaacctcggcgaggacctgctgccgttcaagaaaggcgccttccagatggccatcgccgccggcgtgccgatcgtcccggtgtgcgccagcagctacatccgccacatgcgtctcaaccgctggcgcagtggcaggatcctgatccgctcgctgccggcgatccccaccgccgggctgagcctggacgacatgccgaggctgatcgagcagtgtcgcgaacagatgcgcgagtgcatcgagtcgatggaccgccagctacagacagcctgaaaacagcccgccgcgtgcgggcttttttattgccggcgaactccgcccaacaggctgactctgatcagtcatggggctaagctgcacgaagtctcactcctcatttcgataagaagaagcgaacaggaaccatgggtagagttgttgccgccgctgtctacagcgcaggtagaaaagtcactgatatcaccctcgacgaaggggcggcctgggctgccaaacccgggcacttcgtctggatcggcctcgaagaacccaacgcccaggagctggccaatctgcagcgccagttcaacctgcacgaactggccatcgaagacgccctggaaaaacacagccggccgaaactcgaaaccttcggcgacgcgctgtttatcgtcacctactccccggtgcgcgaagccggcaagctggagttcatcgaaacccatatctttgccggcaacggctacatcatcactgcccgcaatggccactccaaatcctatgggttcgtgcgtcagcgctgcgaggcacgaccgctgctgctggagcacggcgaggacttcgtgctctacgcgctactggatttcgtcaccgagaactaccagccggtcagcgaagcgatccatgccgagatcgacgaactggagcacagcgtgctgtgcagttcgctcaacgagggcgatatccagcacctccacagcctgcgtcgcgatgtgctgcgcctgcgccgctatgtagcgcccatggtggagatcagcgaagagctgcagaagctcagcttcccctttatcgacaagaacatgcgcccgtactttcgcgatgtgcagatccacgtcacccggcagatggaagacctggcgaccttgcgcgacatcgccagccagaccatcgagatcggcgtcctgctggaggcttcgcgacaaagcgtggtgcaacgcaagttcgccgcctgggcggcgatcctggcgttcccgaccgcggtggcggggatctacggaatgaacttcgacaacatgcccgagctgaagatgcactacggctacttcggtgtgctggcgtttctggtgctgggctgtacgggattgtgggcgagcttcaagcgctcggggtggctctgacagcagagccgggccggacgctcctgcaagggccttgaggccattgtagaagcgagccggctgggcgatgcggctatggattcaaaccgatccggtctgcggcttgtacgccacaaaacgcatcatccactcggcaacggtgctgccgtgatgatcccggtccagactggcgatgcccttttgatagacctgttcgcccaggtgctgctggcgcaggtccagcaaggcccgcgaatagtcgtgaatgaactccgggtggccctggaagcacagcacctggtcattgatgtgataggccgcgaacgggcagaaatcgctcgaagcgatgaccgtggcgttttccggcaaggcagtcacctggtcctgatggctgatcaacagcgtcagctcttccatcaccgggctcatccagggcgccttggccgccagtttgtagttgtgggtacccacgccccagccctgggttgcgcgttcgctcttgccgcccagcagcaacgccagcaactgatggccaaagcagatgcccagcagtttgtcgccgcgcttataacgctccagcaggtaggtcttgagggtttgaatccaggggtcggtaccgaaggagtcggccttgctccccgtgaccaggtaagcgtcgaagctttggtcgtcgctcgggtagtggccctgcatcacgttgtagacggtaaattcggcagcgatgggctgctgtgaaaacaggcgctgaaacatctgcccgtaaccctgatattgatcgaccaattctggacgcaggatgtcggtttccagaatgcagatgcgtagcgacataaaaaatacctgacacgtgatgggaataatgaacaccccagagcctgccttgaaacgcctgatcaaggcaagccccgcgatgcatcacttcagtcccttcagcctcagaacaactggcccttggcggctttctccagcagcagcgccggcggcgcgaaacgctcgccatattgctcggccaggtactgggcccgggcgataaagtccttcaggccgtactggttgatgaactgcaaggccccgccagtccaggctgcgaagccgataccgaaaatcgaaccgatattggcatcggccgtcgaacgcaacacgccctcctccatacaccgcacggtttcgatggcctgcacgaacaacaaccggtcgcgcacgtcctgcggcgaaatctgcccatcggctttctcgaagcgggttttcagctgcgaccacaagtgcttctgccccccggccgggtagtcgtagaagccaccgcccgccgccttgcctgggcgcttgtattcattgagcagcaggtcgatcacggcgaaggccggatgctccggcaacggcttgccttcggcctgcaagtccttggcggtctgttgacggatatggctcagcaggctcagggaaacctcgtcgcaaatcgccagcggaccgatcggcatccctgccttgcgcgcctcggtctcgatcatcggcgcggccacgccctcgccaagcatggcgatgccttcgttggtaaaggtgccgaacacccgcgaagtgaaaaagccgcggcggtcgttgaccacgatcggggtcttcttgatctgctggacgaagtcgaaaccgcgcgccagggtttcgtcgctggtctgctcgcccttgatgatttccaccaggggcattttttccaccgggctgaagaaatgcaggccgatgaacttgccttgatccggtaccgccctggccaggccgctgatcggcagagtagacgtattggacgcgatcaccgcctgcgcccccaccacctgctgcgccgccgccgagaccctggccttgagttcgcgatcctcgaacaccgcctcgatgatcaggtcgcaaccggccaggtcggcgtcctgctcggtggtgcggattcgcgccagcgtggcgtcacgctgcgcggcgctcaagtggccacgggcaaccttcttctccagcagcgccgccgaatgggccttgcccttctcggccgccgccaggttgatgtccttgagcaccacttcgatgccagccacggcgctgacgtaggcgataccggcgcccatcatcccggccccgagcaccccgaccttcctggtcacatagggcgcaaaaccttgaggacgggagccaccagcattgatctcgttgagctggaaccagaaggtgccgatcatgtttttcgccacctggccggtggtcagctcggtgaaatagcgggcttcgatcaactgcgcggtatcgaaatcgacctgggcgccctccactgccgcacagaggattttctccggtgccggcaggcagccctgggtcttgctgcgcaggatcgacggtgcgatggccagcatctgcgcgactttcgggtgcgacggcgtgcccccgggaatctggtagccggtcacgtcccagcgctgcttgactgccgggttggcgacaatccacgccctggccttggccagcaggtcgtcgcggtcgctggccagttggtcgatcaggcccgcttgcagcgcctgctgcggtcgcaccttcttgccctccagcagatacggcagggctttttccagccccagcaaacgcaccatacgcaccaccccgccgccgcccggcagcaggccaagggtcacttccggcaggccgatctgcagcgatgggtcgtccagcgccacccggtgatggcaggccaggcagatctcccagccgccgcccagggctgcgccgttgatcgccgctaccacgggtttgcccagggtctccagggcccgcaactggcccttgagggtcagtaccatgtcatagaaggcccgggcttcagccttgccaaccttgatcaactcattgaggtcgccgccggcgaagaaggtctttttcgccgaactgacgatcaccccggcaatcgcttcctgctcggcttgcaggcgggccacgcaggcggccatggcctcgcggtacaccgcgttcatggtattggcgctctggcccggcatgtcgatggtcagaacgacgatctggtcctggcccttttcgtaacggatggcttgggtcatgaaagtgtttccttgaagtcagggctcagaggcgttcgatgatggtggcgatacccatgccgccgccgacgcagagggtcgccaggccataacgctggcgccgcgcttccagctcgtcgagcagggtgccgagaatcgcgcagccggtggcgcccagcggatggcccatggcgatggagccgccattgacgttgaccttgtccgggtcgatggccatgtccttgatgaacttcagcaccaccgaggcgaacgcttcgttgacctcgaacaggtcgatgtcctcgacccgcagcccggccttggccagggccttgcgcgtggccggcgccggcccggtgagcatgatggtcggatcggtgctggtgaccgccgtggcgacgatccgcgcccgtggcttgaggcccagcgccaggcccttggcttcggagccgatcagcatcagcgccgcgccgtcgactatccctgagctgttgcccggggtgtgcacgtggtggatgcgctcgacatggctgtagacccgcaaggcggtggcgtcgaagcccatctggccgatcatctcgaagctgggcttgagcttgcccaggccttcgagggtggagtcggcgcgtatgaactcatcatgatccagcaggacgatgccgttctggtcttgcaccggcaccagggacttgctgaaagcccccgccgccctggcccgcgcggccttctgctgggactgtagggcaaaggtatcgacatcctcacggctgaaaccttccagggtggcgatcaggtccgcgcctatgccttgcggggtgaaatggctgtgcaggttggtttgcgggtcgagcacccaggcaccgccgtcgctgcccatgggcacccgcgacatcgactcgacgccgccgaccaccaccaggtcctcgaagccggagcgcactttcatcgcgcccaggttcaccgcctcgaggcccgaggcgcaaaagcggttgatctgcactccggccacgctgacgtcccagtcagcgaccagcgccgcggtcttggcgatgtcggcgccctggtcgtcgatcggcgtcacgcaaccaagcacgatgtcgtcgacctggctggtgtcgagtccggtacgccgctgcagggcatcgagcagcccggccagcaggttcaccggcttgacgctgtgcagggcgccgttggccttgcctttgccacgaggggtgcgtaatgcatcgaatatcaaagcctgggtcatgacgtcctcgaaccgctgtgcagatgaatgatgacagggctcccactcttggccccgagggccccggattcaatgaccgatgcgctcactgaccttgacggtcacgctcagacgaacggtagtgagctaatggattccgctcaccgcataacggaactgtctagacaaagggcgggcaagaagatggcaataggcctcatgcgttttttaaagcatccgcctattagctgatattaaatggatctaagccaagggttacaaggaccctaaggtaggactgtaggcagtgaatcgttgcagccgggtcttgccggtgcacgcgcaaggaaagggaacacatcgcctggtcatagtgaagcggcaggcatgcagttgatgttcaggaataacaacaaaaggcattcagccatgttcaagcattcgaaagtccgtcaagcggggctcattctgttcgcaaccaccttgcttctgatcttgccgaacctcaccaaagtgatcggctagaggcgtggccatcccgtcacgcaatcgaatctttgtgctccggttcgctaccggagccggcacttgtgtgccactctttctgacgccgcggccacgctgaatcagggcgtcgtcgcgcttaccagaaaactggagacaggccgtacgcgctgctctccaccccagcgacggaacagcgatcaattgaaatctcttattctcctgtgcagcgccctgctgctcaccacacccgtgcatgccgcgcagctgaccctggaactgggggccggcagtcgcacctggcagaccgaagaactgctcaagcaccctcaggcccggaccgtcaccgtcaaggatgacgtgtcgtacaaacgcgacatgagttaccgcgcggtgccgatctcagccctgctcaccggcatcaaggctgatgaccatctgcaggctgtcgccctggacggtttcgccgccgaactgcccgccgcgcccctgctcacccaggacggcgcgcaggcctggctggccatcgaagacccggccaagccctggccgcccctggctgaaggcaagcacagcgccgggcctttctacctggtgtggaccaacccgcaggccggtcatatcagccccgagcaatggccgttcgaggtggcgagcatcaagcgcctggcgccggtggcggaacgtttcccggccctgcgcccggaccccaagctggcggccggcgccccggtgaaccagggcttcgccctgttccagaagaactgcctggcctgccatcgcctcaacggcgccggcgactcgcagttcggcccggacctgaatatcccctacagtcccaccgagtacttcggcgcggacttcctcaagcgttacatccgtgacccacagagcttgcgtcgctggccgcaggcgaagatgccggccttcgcaagcagcgtattgccggatgccgagctggagttgctggtggggtatctgaagcatatggcgggacgtaaacaggtggcgcaataaagctgtctcggggaggtgtcctccgggacgccatcgcgggcaagccttgcgtctaccgtcgagcgcactccccggcaagcgctccattgccacgccatgcaatggctatcgacggcatagccagacttgatttcaccgcctgggcaaaactgcgcagaattcgctgcaacagcgcaaacgacttcagcctcccagacgcgcagtcaatgcctcctttcatggcgccaatggcagccggccccggaatgtccccgaccggtttcctctcctaccggtcttcccttttggccaccctcagcgggtggcctttttttgcccgcctctgtagcgaggcttgcccgcgataaggccgacgcggttttgccgaaataccgcgtatcaaacgcaagctgcgctcctgcagatcccggaggcagaaacgaaatcggccgacccgagggtcagccgatgctgagtcttgacgctattcatatgcactaaacgagtcgacctcgaacctcctgcttcacgccccaaccctcgatgatcccgcccaggggcgcgactaccgcttcaaagtcctgctcgaaatcgccgatgccgccgtaggtggcgtacatcaccttgctcagctccaggtaccaggcgccgtcatcgcgcacgctgacctgggcattcaaggattcaccgcggaactgccctgccgccctgcgtgcccgttcctcgtccgggaaaatggcgtagaactcgatgggatggaatcgtgaaaagtcgaaaccgccttctttcatgcggcgcagcacgctgctgctgatgtcttcttgataggctgtgctcatgaaacgtcctcctcaaaccgatggatagactttccgtactcccttgcctgtcaccgcacggtgcaggcttgcggcgagaagatcgccgccaggaaacaagcatgtagctgacaagaccagaccttagcgattcattcgctgatctcgaatgcagagtagcgccaagacgcgggcgctgccaagatctgggttcaagctcggtagggctttgcgcattaaagattaaatcggcgtaatgctgaggatttgaatgctgttctgatctttcaggctcttgagcgtagggtcgtcggtgcgcccttccagatcgttgaggtcaagctcggccggaaccggcaggagctttgcgcgaatcaattgtgccgcctcctccatgctgggctgctgctcacagtcgaactgctcgactgactggacaccatgatcgtcaacgaaagtgacttgccacttttgcatcagtgcctccttgatgaagcccatggatggactcacaagatgtcgaccctgaagagccaataatcgttcaaaccgaggatccggcggcgccattaaaaaggccaccctgggggcagcctcttttgcaacgaccggcgcttacggcttctcggcgcgcgccttgagtgccttgagggtattgaatggcgcatccacgacaaacttgttggccagccaggatggcacgctgccgcctggctcggtgtgcacctggtaggtcacttcgacctgatccgcgcccttgggcacgaatttccagaagccttcgacctgggcgacacgcacgaaacctttctcgtcgggaacataggtcggtacgccttcgagcttgcgggtcaggctgccatcggccgcttcgctggtggtgacgtgcagcaccgaatcacgcggggtgaccggccacggggtattgaactgggtgtaggtccaactctgctcaccttcgtgcttgagcaacttctgcgacttgcattcgtgaatccaggcgcaggcgcccgtcacgtcgtcctgcagcgcgcgcagcttggccacgctggttttcatggtggtcacgccccggtacgccttgtatttggaaccggccacttcactcaaggaaaccttgatgccgtcttcatccttggccgtttgccaatcttcggcgtgggcggttgccgagagcaaaacggtcaacccacagagcacagcaattcgatgcagcgaacccattgtcttattccttattgttgaagttccgttcattgaaaacacttcacgccgccgtcatttgctcccaccagcccaacaagcggatagcctcttcccggctgccgccgcagacttcgacatcagcctggaacgcaccacagacggcgggccgttcgggttggccgaacaaaccgcacagcagttcgacagaaagatggatgcaacgttctccggccggtttgccattgggcattccgggaatcggggtactgatggaaggggcaatgcaacaggcgccacagccttcacggcagttcatgacgacaagctcctcgcgacgggcaaagtattgaaatgacgcggactagagtaaccgctaaaacagccgtttgaaattggccgcccactggtttttacgctcaggctcgcgtgactgaccagtctccgacaaagcgtcagggctgcgggtcacagtcaggatgagggtttactgcttgaactcgaaatccagcgccgcgccttccacatcacgccgttcgtcattgcgcagctgcaactgcatttcgttgctcagcaggcggccgttgagctggaacggactgtcgtccttgggtttctcgccgaacatcggcggcagcaacggggtgcgcttgggctggttgaccgaaccgatcggctgcaattgcttgaccatttccggcggcaggctcagatccacattggccgaaggcaaaggcgtcttcacgatctcgctggcaggcttggacttggaggcaatcggcgcgcgccttttctgggccttggccttgggtttggccttgctggtcgcggtcgccttctttaccggtgcggttttcttggctgctacggttttctgcgacttattagcggtggcgcttgccgcgaccttttcctgggccggagctgccagaacgctggccgtgccgaaagcactcaagacactgaccaatacccaggcaacaggaaaaatcgctttcatagagagacaacaggattggcggcgaagagccatatgctcgcctgttgaccgcgcgaaaacaagcgcggtaaccgatccttcaaaaaccgcccgcggcctcctggcacagctggctggccaacatgcccagggtcatcagtgcccgctcggcctcgcgattccacggggtgccgcagttgaggcgaatgcagtggttgaactgctcggtattactgaagatcagccccggcgcgatactgatgccctgctgcaatgcccggacatgcaattcctgggtattgacccgccccggcaggctgacccagagaatgaaaccgccgttcggacgggtaatctgcgtgccttccgggaagtactgctgcaccgccagctgaaaggcgctgaggttcttgcggtactcctgacggatgaaacgcagatgccggtcgtaaccgccgttttccaggtaggccgcgacccccatctgggtgacgctgcaggccgaatgagtgctgaaggtctgcaagcgctggatttcctgctggtacttgccggcaatcatccagccgatgcgcacgccgggtgacagggtcttggaaaagctcgagcaatagatcacccggtccagccggtcataggctttcagcgccttggtacgaccgacctcgaacatcagttcgccatagatatcgtcctcgaccacctggatatcgaaatccgaggccaggcgcagcaattgtttctgccgctcttccggcatggtgccgcccagtggattgctcaggcgcgtggtcagcaccagcgccttgatcgaccattggttggccgccaattgcagcgcctccaggctcatgccggtggaagggtcgctgggaatctcgatgaccttgagcccgagcaggtcggccagttgcagcaggccgtagtaagtcggcgactccgcggcgatcaggtcgcccgggcgggtcagcacgcgcaacgacatctgcagggcatccacgcagccgtgggtgatcaccacttcggacggatcgaccaccacgccggcgtcgcgcatgcgaatcgccacctgccggcgcaacggctcgaaaccggggctgaacatatagctgaaggcacgcgggctatggaaacgggtgaccttggccagttgctggtgcagcgcccgcaccggcaggtaatcgacgctgggcaccgcggcgcccagcggaaacacgccttcacggcgcgattccaccaacacctgatgaatgatgctgctgcgcgtcaccaggcctggccgttcaacccgggcgatgtccggggtcggcgcggtcagcgccggggtctggtgcacgtaataacccgactgcggacgggcgcggatcagcccctggtcctcgagattggcgtaggcctggagcaccgtggcatggctgacattgagctgggaactcatcttgcgtaccgaaggcacgcgttccccgggctggtacacaccacgacggatatcttcagccagctgctgagcgatacgttgataaagcaagagattggtcatgacgctgcactcgatttcaccggcattttattcttgtggatgacgataccggaacagttcataagtgtactgggacagttgccacaatagtcgaccgtacagggcagtgtcagcaaaaactgtactgttttgtgtaccaatcgtcaggcacaaaaaaacccggctccacaggaaaccgggttgttttgaccatccgcgtcttagcgcgcggcgcccaactggcctttctcgtcggagaagacgatttccacccgacggttctgcgctcgcccacgttccgaggcattggcctcgaccgggtactcatcaccataaccttcgacctggacccgtttctcctcgacccccaggtccaccaggatatcggccacggcctgcgcccggtcgcgggacagtttcagattgctctgcttgtcgccggtgttgtccgtgtaaccctcgattcgcaccacgcgcttggggttcagctggagaaactgcacgaccttgagcacagtgcggttggccgagcttttcagctccgcttcgccggtgtcgaacagcacatcgcccagggtcatcaccagcccacgatcggtctgggtcgtggccaggttgatgatctgctcttccaaccacttgccctgctgctgcacgctcagcaacttggcctcgcgcagggccagttgcaggcgctggcgttcgagttcgagcttggccgcctgctcctggttcagtgcctggttggtgtgctcgcgagcgatttcgctgtagcgctggctgaggtaggcgtagtgcaccacatccgaaccgctgccccagtagctggacaggcgatcggcccgggccagggactcaccggcgcggatcacatccttgggtgcgatgcgcagcacattggaatcttccttgaccttctggaagtcctcgccggcctgttccagcgctgcttcgctgcgttgcccggcgcagccgtagaggccggtgcaggcgatcagcagggcgccacccaatactcgagtcagacgaatcattgggcgtctcccaactgcttgcgcagacgagtgatgcgagtctggacgacgttcagctgttcctggcttttcagggtcaggacccgcgcctcggccaggcgcgcatccagttccgcctgctcggcacgcatgcgcgcgtgcttgaacgactcttcctgcatgttgcgttgggcacgggcgaatttgtcctcggccagtttcatttccggcacatcctctgccgtggctcccacggccttggcctgggccagggtttgttcggtcaggcgcatttgttcattcggcgccggatcggctgcgcaacccgccagagccaggacggccagggcagcgaaaagaggtcgaatactcactagaaatccctactgtttgggggtgctgacaggttgctgcaactgtgccttccaacgctcgagattgcgctgcagcacggcttccgtcagaccggacgcgggcaattctgtcatctttttcgccaactgtccgcgcaaccatgggtcgttgcaggcggagttgtgcgagatggccaggaacaggccaggtttgtcggcaggctgcggaaatgccagcagatcgttggccatgcccagcgactgggccagggccatgccggcgtagcgtccggccagtacgtactccacctcccccagcaacagtttctggaatgcctgggtcagattcggcatgcgggtcaggctcaattgctccttggcgaaggcctcgaagggcggcgtcaggcgcgccctttccgacaatgcgccggtatgcccatgcaggtccgacggctgactgtagctcagcgtcgagcccttgcgggtccagaccaggaaatcgttctccagcagcggcggatgaatgtagtccagcgcttccagctcactcaccgtcagcggcgcgtcggccagcatgtccatgcgcccgctgcgcacttcatccagggcggcggagcgtttgccggcatacaacaactcgaccttgatccccagttcctgcgccacgtgttgcagcagttcggcgctggcgccaatcaggtggctggggtcctgcgggtcgcgccatagatacggcggggcatccggactgccggtcaccaccaggcgctcgcatttaccggcggccatcgacgacaacggcatcagtgtcagccccagcagcactgacaggccacccaggcggcgcagatccatggcgaaattctcccactcaaatcccagacaataaaaaagcccggccaaaagaccgggctctcttataagtgaagccgctggattagaccagcttctccagctctggtacggcttcgaacaagtccgctaccaggccgtaatcggccacctggaagatcggcgcttcttcgtccttgttgatcgcaacgatcaccttggagtctttcataccggccaggtgctggatcgcgccggaaataccgacggcgatgtacagctgtggcgccacgatcttgccggtctggccgacctgcatgtcgttgggtacgaaacctgcgtcgaccgcggcgcgcgaagcacccacggcagcgcccagcttgtcggccagggcgtacaggtgtttgaagttgtcgccgttctgcatgccgcggccgccggaaatgacgatcttggcagcagtcagttcaggacggtcggacttggccagctcttcgccgacgaagctcgacttgcctgcgtcgtgagcggcagcaaccgcttcgacagcggccgaaccgccttcggcggcaaccggatcgaaaccagtggcgcgcacggtgatgaccttcacagcggcgttcgattgcacggtggcgatggcgttaccggcatagatcggacgcttgaaggtgtcggcgctttctaccgagatgatctcggagatctggtcgacgtccagctgcgcggcaacgcgcggcaggatgtttttgccgttggaagtggcggcggccaggatgtggctgtagcccttgcccagctctgcaaccagaggggcaacgttttccggcaactggtgcgcataggctgcgttgtcggcggacaggactttgctcacgccagcgattttcgcggcggcctcagccacggcgccagcgccctggccggcgaccagaacgtggatgtcgccaccaattttggcagcggcggcaacggtgttcagggtggccggagccagcaccttgttgtcgtgttcagcgattaccaagatagtcatgatcagattaccttcgcttcgtttttcagtttctcgaccagttcagcgaccgacttgaccttgatacccgcgctgcgtgcagccggcgcttcgactttcagggtcttgttggtagaggcggtggaaacgcccaaagcatcaggagtcagcacttcaagcggcttcttcttggctttcatgatgtttggcagagacgcgtagcgcggctcgttcaaacgcaggtcggtggtgacgatcgcgggcaggttcagcgaaacggtttgcaggccgccgtcgatttcacgggtcacggcaaccttgtcgcccgcaacgatgaccttggaggcgaaggtgccttgagcgtagccgctcagggctgccagcatctggccggtctggttgttgtcgctgtcgatggcttgcttgccaaggattaccagttgaggctgttccttgtcgaccacggccttgagcagcttggccacggccagggagttcagttcatcagcggactcgacgaggatggcacgatcggcacccagcgccagggcggtacgcagttgctcttgagcagtagcgggaccgatggagacgacgacgatttcagtcgctacgcctttttctttcaggcgtacggcttcttccactgcgatttcgcagaaagggttcatcgacatcttgacgttggcgaggtcgacgccggaattgtccgccttgacgcgaaccttgacgttgtaatcgacaacgcgtttgacagctacaagaaccttcatggattcctcgttactctccggtgaaaagaaagtcgcctaggcgaacctggcggttgatgctcatcgggcacaagggcacctctaaaaacgctggcatggactcttgcaacagcagacagatgaccttgctcacgggatgatgaccgttcgtcagtggcgactgatcggtcattctttatcgcggcgtgtaaactgcgcgttgcgtcaccttgtacagccttcgccctgtctttagaggtgctcttgaaaccaacagtcagcctacggcgagcgcaaaaccgaccgtatcttgaccggaacgcctattctggtcaatacgccaaaatggccagtcataagccgcgcttctttgatttacatgggctgcagcaaattcaaacaaacgtttgtattggacgctaagagtggtgtagatataatgcgccgcctagagagaaaggcgggtcgttcattgtcccctcccctgtttggcggagaaaaccatcgatgcgacacccaacctccaattagaaaaaaaccgttgagccttgagtaggagatagcctagtggaacgcgaatacatggaattcgacgtggtcatcgtcggtgccggccccgctggcttgtccgccgcctgccgactgaagcagaaggccgccgaagccggtaaggaaatcagcgtctgcgtggtcgagaaaggctccgaagtcggtgctcacattctttccggcgccgtgttcgaaccgcgcgccctgaacgagctgtttccggactggaaggaactcggcgccccgctgaacaccccggtcaagcgcgatgacatctatgtcctgaaaaacgccgacagcgcgaccaaagttcccgacttctttgtgcccaagaccatgcacaacgaaggcaactacatcatctccctgggcaacctgtgccgctggctggcccagcaggccgagaacctgggcgtggaaatctacccgggcttcgccgcccaggaagcgctgttcgacgagaacggcgtggtccgcgggatcatcaccggcgacctgggtgtcgaccgcgaaggcaatccgaaggaaggcctgtacacccccggcatggaactgcgtggcaagtacaccctgttcgccgaaggctgccgtggccacatcggcaagcaactgatcaagcgcttcaacctggacagcgacgccgacgcccagcactacggcatcggtctcaaggaaatctgggaaatcgatccggccaagcatcagccaggcctggtggtccacaccgccggctggccgctggacatcatgggcaccgagaacaccggcggctccttcctttatcacctggaaaacaaccaggtggtggtcggcctgatcgtcgacctgtcctacagcaacacctacctgtcgccgttcgacgaattccagcgcctcaagcatcacccggtgctcaagcagtacctcgaaggcggcaagcgcgtcagctacggcgcgcgcgccatctgcaaaggcggcctgaactcgctgccgaagatggtgttcaagggcggcgcgctgatcggttgcgacctgggcaccctgaacttcgccaagatcaagggcagccacaccgccatgaagtccggcatgctcgccgctgacgccgtggccgatgcgctgttcgccggttccgaaggcgccgacgagctgaacacctatgtagaagcgttcaagtccagctggctgtacgaagaactgttcgccagccgcaacttcggcccggcgatccataagtacggcgccatcgtcggcggcggtttcaactgggtcgaccagaacctcttcggtggcaagctgccgttcaccctgcacgacaccaagccggactacgcctgcctgaagctggccgcggactgcaagaagatcgactacccgaaaccggacggcaagctcagcttcgacaaactcagttcggtgttcatctcgggcaccaaccatgaagaagaacagccttgccacctgaagctgaccgatccgagcatcccgatcggcaagaacctgccgctgtacgatgagccagctcaacgctactgcccggccggggtgtatgaagtgatcaccaaggaagacggcgagaagcgcttccagatcaacgcccagaactgtgtgcactgcaagacctgcgacatcaaggatcctgcgcagaacatcacctgggtcgcgccggaaggcgcgggcggtccgacttacccgaacatgtaaggcgtacgcttgaagaaaaaggctcccgaatgggagccttttttattgccggcgccactgccctgcttctgtaggagcacagcttgcgtgcgataaggatttggcgatgtatctgtcagaccatctcacccttcatcgcgggcaagcctcgctcctccagacgagcgcctcccatcacgctgctcgctcatcccccggattgcgctcgaagtagcgcttgtattcacggctgaactgcgaggtgctctggtagcccacccgatgcgccacctgggccacgcccagcccttcccccagcagcaactgctgcgccttgagcaagcgcaggcgcttgaggtactgcaccggcgacagcagcgtgctgcgcttgaagtgctcatgaaaggtcgaggtgctcatgttcgcgcaacgggccagggtctcgacgttcagcggctcggtgtaatgctcgtgcaagtgattcagcgaggccgccacccgggcaaactgcccgtgctgttccaccagcgcgcgcagtacatcggcctgcggcccgcgcaagacggtgaacatcaattcgcgcaagcgcgcctggcccatcaccttgcactccagaggatcgtgcaggcagcgcagcaggcgctccacgcaaccgcgcatcgtgtcgtcgagcaccaccgaggtcatcgactccggggtctgcgcctgggcactgcgccccgcggcaacgcccatcgccagcaccagctcgcccaacagcgcccggtcgatggcgatggacactcccagcaatggcgcattgggcatggcgaaggtctcgcactcgaagggcaccgacagcgcctggatcaggtaatgcccagcgccgtactccagggtccgcgggcccaggtacgccagcttgctgccctggacgatgatcatcaggctcggctcgtagatatgcgggccgcgggccacgtcgcaactggcccgcaacacctggaccccgggcagccccgtgggaacgaaaccgtcgcgggtcgcaagaggctggatcagggacaccagggtggcattggcatcgagatggcgggtcaacaacatggggaaaacttcacggaaagagggatgaaaacatcatcgcaggtctgcacgccaatgccgcgcgcaaatggccgatggcggaggaataggcatgacatgccgaggaatcgccatgttcgcgccaggcagcggcgccgagaatggcccgcctcacctgtcagtgcttttgcgaggttcatcatgtacacagccatcggttacgccgcccagtccgccaccacgcccctcgcccccatgagttttcagcgccgcagcccgcgtccggatgacgtggcgatcgagattctctactgcggcgtctgccactccgatatccaccaggcccgcaatgaatggggcatcgccgtgtacccgctgatgccgggccacgaaatcgtcggcaaggtcaccgccgtcggcgcccaagtgaccaggcacaaggtcggcgacttggtcggcgtcggctgcatggtcgactcctgccggcattgcgaagcctgcgccgcgaacctggagcaatactgcctggaaggcccgaccatgacctacgccaccccggaccgggtcgacggcagcaacaccatgggcgggtactccgacagcatcgtggtcagcgagcactttgtcgtgcgcattcccgagaaactcgacctggccagcgccgcgccgatcctctgcgcgggcatcaccacctactcgccgctcaagcattacggggtgaaggccggcgacaaggtgggcattctcggcatgggtggcctgggccacatgggcatcaagttcgccaaggccctgggcgcagaagtgaccctgttcacccgttcggcgagcaaggccgaggaagcccgtcgccagggcgccgctcatgtgatcgtctccaccgatgccgagcagatgaaggccgcggccggccgcttcgacttcctgctggacaccatcccggtgcaacacgacctcaacccctacctggataccctgcgttttgacggcgtacatatcctggtcggtctgatcgaaccggtggacccgcccgtgcacgcggccaagctggtgctgggccgtcgcgtgctggccggctcgctgatcggcggcatcgccgaaacccaggaagtgctggatttctgcgccgagcacaacatcacctgcgacatcgaaatgctcgacatccgccagatcaacgaggcttacgcgcggatgatcgccggcgatgtgaaataccgcttcgtcatcgacatggccaccctcaagcaataaaccgcgttctgtaggaggcttgcccgcgatggcgatggacctggaaaaatgccatcgcgggcaagcttcgcctatggaagcctgagtcagccgccgagttcggcggagatgccggccgcggcctgcttgatcaccgggatcagctcggccattttttccagcggcatgtacggcacggtgctggcgatactgatgccggcgacgatcttgccgctggcatcacgaatcggcgccgccacacaacggatcgacggttcgttgtcctccaggtcgaaggcatacccccccgccacatagtcctgcatgcgctgctggaactgctcccaggtcggctcttcatgctgcggccaaagcgcattcctgccgcccgccggcaggctcacttcatataaacgctgccactcctgaggcgtgctatcgagcagcagcgccttgccgatcccagtgcgcgccagcggcatgcgatggccgacccgcgaacgcatttccgggccgttgcgccccgggttcttgtgcaggtacagcacatcgtcgtcttcgcggatcgccaggtgaatggtgtcgccggtcaacgccgacagctggtcgagaaacggcctggccagggtcaccaacggcaaggcctcgcgggcctggaaacccagctcgatcagcttcggccccagcaggtagccgacctgcggcaccaccctcaaataacgctcgtccaccaggcaactggccaggcgatgggtggtgctgcgggtggtgccgatcagccgggcgatttccttgaggtcgcgggcaccgctggccacggcctgcaccaccgccagaccacggagcaatgtctgggtaccggtgggggcggcatccttggcggtctttgctgcgtcgtcctgcatatccagccttccgagggtgagaacgggcggcattatggtcgcccgtcccccgccactacaactcgatacgctcgaccttgcccaccagcagcacgtaggacagggcccccgccagcgccagcacggcaatgtaggtaatggccggggcaaaggagtcgccgctggcgaggaagccgatgacgatcggcgtggcgatcgccgacaggttgccgatgaagttgaacaccccgccggtcagccccagcaaccgcgccggcgccagggtcgaaaccagcgaccaggtgatcgaggccaggccattgccgaagaacgccagcgccaggaaggcgatcaccagcggtgtcgactcgacgaaattggcaccgatgatcgaggtggaaatcaacagcccgccaatgatcggcagcttgcgggcaaaacccaccgaggcgccgcgccggatcagccagtcggagaagaacccggaacacagcacgccgacaaaggccgcgaggaacggcagcgacgccagcaggccggacttgatgaaatccatgccgcggtacttcaccaggtaagtagggaaccaggtgaggaaaaaccacagggtcgaattgaggcagaactgccccagataaatgccccacagcttgcgcttgctcaggacaatccccaggtcggtccagctgaaacgcgccttgctcctggccgtctcacgctggatatccaccaggccgccaccctggcggatcaggtcgatttccgccgggttggcgcccttgaaatcccgtggttcgcgatacaccgcgtaccagatcgccgcccacagaatgcccaccgcaccggtgacgacaaacaccatgtgccagccaaaggcatgctgcagccaggccagcaccggggtgagaaaagccagcccgacaaattgcccggaagtgtaaaagccgatggccgtggcgcgctcgcgctcgggaaaccaggtggtcaccacccggctgttgatcggataggccggcgcctccagcgcacccaccgccatgcgcaggacgaacagagcgataaagctggcggcgaagccgagcatcaccgtcgccagcgaccacagcagcagtgccgccgtgtagagaatgcgcggcggcacccggtccaccagccagccaccggggatctgcatggcggcgtaggtccagccgaaggccgagaaaatcagcccgacgtggattgggtcgatgcccaggtcgcgggtcaaggccggcgcggcgatcgacaggttgctgcggtccaggtagttgatcaccaccgtgatgaacaacagcaccatgatgaaaaaacgcttgcggctcggcgcgaccagcgacgcctgcccgatgaaggtctgcggttgcatgggaatgcctcttcttatggttattgagggcaatgtttctctgtacctgtaggagcgagcttgctcgcgatggcgtcggttgcttcacagcgataagaagtcagcccctgtcgcctgcatcgcgagcaagctcgctcctacaagcaatgaatcaactcaccattcggcgaagctgccgtcggcgtggcgccagatcgggttgcgccagcggtggccgatggccgcgcgctcgatgacgtattcctcgttgatctcgatgcccaggcccgggccgttgggaatcttcaccatgccttgctggtagtcgaagacgcgcgggtccttgacgtaatccagcaggtcgttgctttcgttgtaatggatgcccaggctctgctcctggatgaaggcgttgtagcaggccgcgtccagttgcaggcaggcggccagggcaatcggccccagcgggcaatgcagggccagggccacgtcgtaggcttcggccatgttggcgatcttgcgggtttcggtgatgccaccggcatgggaagcgtccggctggatgatgtcgacgtaaccttcgctgagcacccgcttgaaatcccagcgcgagaacagccgctcgcccagggcgatcggggtgttggtcagcggcgccagttccttgagggcctcgtagttttcgctgagcaccggctcttcgataaacatcagcttgtagggatcgagttctttcatcagcaccttggccatgggcttgtgcacccggccatggaagtcgacgccgatcccgacattggggcccaccgcgtcacgcaccgcggcgacgttggccagggccaggtcgaccttgtcgaaggtgtcgaggaactgcagctcctcggtgccgttcatcttcaccgcggtaaaaccacgcgccaccgcctctttggcggcacgcgcagtgtcggccggacggtcgccgccgatccacgaatagacgcggatcttgtcccgcacctggccgcccagcaggtcgctgaccgacacccccagggccttgcccttgatgtcccatagcgcctggtcgatcccggccagggcactcatgtggatggcgccgccgcggtagaagccgccacggtagagcacggtccagatgtcctcgatattgcgcgggtccttgccgatcaggtaatcggccagttcgtccacggcggcggccaccgtgtgcgcccgcccttcgaccacgggctcgccccagccggtgacaccctcgtcggtctcgaccttgagaaagcaccagcgcggcggaacgataaaggtggtcaacttggtgattttcatcttcttgtctctcttgtcggatgcagcgccaagggcgccaaaaagtcttaacgcagcgtattccaggcggcgacataggccttggcgcgggtcgccacctcggcggcgctcatccctggcttgaacaacccggagcccaggccgaagcccttgaccccggcgtcgacgaacacctgcatgttgtccggggtgatcccgcccaccggcagcaacacggtgccggccggcaataccgcgagccaggccttgaccaccgccgggcccatctgctcggcgggaaacagcttgagcacgtcggcgccttcggccagcgcggcaaaggcctcggtcggcgtggccacgccgggcgacagatagaggccggcggccctggccgcgcgcagcaccttgggatcgctgtggggcatgacaatcacctggccgcccgcggccttgacctgctcaacctgctccggggtcagcaccgtgccggcgccgatcaggcaatcggcgggcaaggcgtcgcgcaggatgcggatgctgtcaaagggttgtggcgaattgagcggcacctcgataacccgaaaccccgcctgatacagcgcctcgccgatggccgccgcgtcttgcggacgcagcccccggagaatggcgatcaggccgttatgtgccagtgcttgcttgagcatgtcggacctcttttcaagggtgagcgcaagggacgcgcgccagcagcccggccgcttcggccaggtgccatagaccgcgttcggtggcctgttcggccaggattgcccggggaaaaccgcaggcggacaagacccggctgtaacgggcgcaaagctgggaattgccgatcagcacgatcgacggcaatgggtcgctgtgacgccggcgccgctgcacagaggccaatgcgcaaagttcgtggccgatcagcaggcccgacagatagtccggttgggcgcgaccgctgagttcaccggtcaaccccaggctgcgggcgctgaacagggtcgacagcgggccgatttcgccctcggcggacaaggccacctgcacgccgcggtcgaaggcctcggcgtcgaatggcgcgccccgctcctgggtgcggccgagaatgctgtgttgactgagcacggcgaacagctcgccggtcatgaaggtgtcgaaatggacgatgcagccatcggccacctgcacccatttggaatgactgccgggcaggccgatcagcacgtcgttccctgccccgtccggcagctgcggcagcgcccccagcacctgggtttcttcgccccgcatcacgttcggcaagcgcgaacgctggatcacccccggcacgatatgcacgtccaccccgcgccgactgcgcaaggtcaccagggcctgcccgagctgggcgacatccgccggggtctcgcagtaactggcctcgcgccagccctgggcgctgccgaccatgccgcaggcaatcaccggcagtcccggttgcgcgtcgagccagtcgccgcaggcctcatcgaaggccagttcaaaaccgtcgtcgcagcgctggccggcaatcatccgtgccaccttcggcaactgcatgacccccgaggtcaacgcacgctgttccagcacctggccgcctgctgcgagtttgtaagcacgaagggaggtggttccccaatcgagcgcgatcaattgcgcctgcatcgcttcacctgtgagttgtttttggcagtgagtgcgtaagagctgatggcggcgactataaacccgacccgaataaaatctcaatatataaatatcattcccatattatgggatttaaatcccctgtagtcgctgccgcaggctgcgataggaccgaaggtcctccagcgatctcaagacctggcgtccgctgcgtcggaatgccgcccaggccgttcgcagcctcgcgagctcggcagcggctacagggcttggcgtcggcaggccgggcggatgttaatcagggggctaggcgcgtgctgcgccggatatatcagaggaggtcgaagctaagccgaccagaggcgatgccccctgggggcatcgaaacgggggaatttgagttcagcgaaggccctgcgccagcggcggccttgtgggtcacttgttgccggggcggcagtcggtgttgggtaaagcggccggtcagccctgggcgaacgcgcgcagcacatcgccatccatgcggtacctcacccactcttcctggggctgggcgcccagggatttatagaactggatcgccggttcgttccactccagcacgctccactcgaagcgcccgcaaccgttgtcgcaggcgatccgcgccaggtgccgcagcagctgtttgccagcgccgccgccgcgttgtgcgggggtgatgtagaggtcttccaggtacaggcaattgctgcccagccaagtggaatagctgaagaaaaacaccgcgaaaccgatcggcacgccgtcgcgcaggcagatcaggccgtgggccgtggcgccctcactgaacaggctgtgttcgatgtcggcgacgctggcgatgacctcatgacgagcacgttcgtaatcggccaactccctgatgaaggcaaggatttgcggtgcatcgctgggcacggctggacggatttcgacggacatcggcgggtctcggttggaaggcaggcggccatattaaatcgacaggggaaggacatgcacgggtatttcacagggatatgcctggaggtcgtgacgggtgattgtccatgtcggaattgcccgatacctgtagccgctgccgctggttgcgatcggtcgcgaagcgcacggcacttttatcgacgcccgaaggtcccgcgggccttatcgcagcctgcggcagcggctacagtgtgcgcctgtatttttactgcctggctgaaatgacttccgacgcttttgctcccctgcccgatctcgccaacaccctgctgccccacgcgctggagcccgtcgacgacggcgcccacgacctgtcgcacctgcagcgggtgtgggccaatgtgcggcgcatcgccaaggaagacggcggcgatttgcaggtgctgctagccgctaccctgctgcacgactgcgtcgccgtggaaaagagctcaccgctgcgcgcccaggcctcgcgcctgtcggcggaaaaggccgcggccctgctgcaccggctgggctggcccgaagcgaagatcgccgcggtggcccatgccatcgaagcccacagtttttccgccgccatccaggccgacaccctggaggcgaaaatcctgcaggacgccgaccgtctcgacgccctgggcgctctcggcgtggcccgcaccttctatgtcggtggccggttgaaccgagccttctacgacccccacgacccgcacgccgaacaccgcggctacgacgacctgaacttcaccctcgaccacttccacaccaagctgctgcacctggccgagggtttccagaccgtgaccggcgcgcgcctggcgcaggtgcgccatgcccgcctgaagcgcttcatggacgaattcatcgacgagattggtggctgacttactccgctgcgggctaatcctgaagcctgcaagatcacaactaacgcgacagccgcccatggtagaacggcgcctcatgaatccaacaagaacgaggcctgcgcatgtccagcgctactccaccccccatggttccagccaggctgttcgggctgttctgcgtcgccagctacctgctgtcgctgtcctatggctcgaccttcctgctctcgctgctgatcggctcgcgcggtggcaatgagcacgatgccggcagcgtgatttcggtcgccatgctcagcacctttttcgccgtgatcttctccgggcacctgtcggatctgctgggcgccgcgcgctcgattgccctgttcggtggcctgctggtggtcgccagcctgggctttgccctggcgccgggcttcggcgatgccctgctgtttttcggcctgaccctgggcctgggctggggcgtgttctacaccctggggccgatcatcgtagcgatgatggtggctccggcgcagcgggcccggttcttcgccctgttgtcgggcagcatgatgagcggcatcggctcgggtccgctgctggggcggctggccaatgccctgggctatccgttgagcacggcgtttctgcttgccgcggccgccagcctgatcggcgtgctgatcttctggcgcctgggcgcgctgctgaaaagacaccccagccatctggggaccggcgcggcgaaaatcagttgggccagcagcgcccgggtgctctcgtccaaggccttgttcccgatcctcatggtcggtctcggcggctgcgtattcggcggcctgtcgagtttccagaccagctacgcggcctcccgctcgctggactattcgctgttctttctcggcttcatggcagccgccatcggcagccgtttgctgatcgccggcttcgtggtcaagcgcgacgcctatcgcgcggcgtgcctgctctcggggctgatgctggggtcgatcctgatgttccagctgatggtcgatgacgcggtgagttatctgctggccgccgtggtgctgggggtcggctacggcctgacgtactcggtgatcaacggcctggccgccaacgaagcaccgcccggcgacacctcgcaagccttgctgctgttcagcctggcctacttcatcggggtgttcggctttccgctgctggccgggcggatcatcgtcgaacagggcatgtcggcgctgatgctcacggtgctgggcatcgccctgctgaactggctgatcagcgtcgggcgcctggtctggcgcgggctgaaacccgaagaggtcgcgcagaacgcctgaaccgttcgtcgttcatcaggcaccaatcaaaatcgccggcagcccaagatcaggtagcgactctaaaaacgaatggaggcgacatcatgatcaaatccaggctgacgctcctcgccctggccgggctgctgtcctcggcggccttcgccggcgccagcggcccgaccgatccggtggaacggccaaagtcccccgccacccaaggctcgccaaacatcaatatcaacccgccacaagtcgatgaaagcaccctgccccccgccacgggtaccgatccgcgcatccagggcaacgacaccggccgcgccggcaccctggacaccgacccgccggacagcaagccgaaaaccaccaccggcggcacaggctccgaaggccacggcaccgatcaatgaaccaggcacgcacctttcccccacacagaggtccgcatgaacgtcgacaaagagctggaaaaagaagtgctcacccgcttgctgcacgcccaccccaacggcctgggcaaggaggtgctggataactatcgcggcgaaagagtcgtggccagtaccctggcaatgttgcaggaacgcggcttgatcaaggagggccatgtcaccctcaacccggcgggcgaacacgccctgaacctgccgatcaagctgaccgcttccggagtggaagcggcccgcaagctggacgcctgatcgaagaccggggcgttcgttcgcgcccaccggcacccgcgttaccacgcgggtgccgtcagcgccgactcagcaggtcggatggttgaagcgattgatcatgttgccgtaggtgcggttgtagcggttggccgagcggacgatgctcgaactctgcatgtgtgccggcaggttcttcatcgcgccctcgggagcgtgcttgtacaccccgtccttgacgtcgcggacgatcgaacgcgactggccgatgaactcattgatttccagcatgccgccaccgcacgacttgccgctctctgcggcctgggcgctgaccttgccattccagcccgcggccgcgtcggccaccagtgccagggacttctcgaaggccgccagggcctgcggatcgttcggttcggcgaacagggtctcggcatcggcggtgttgagtttgccgtagtagatcaacccggcacggtagtaggccgcggtgtctttcggcgcctcatcgaatgcctgcttggtcagcgccaggtcacgcgccccaaggccggcgtagaagccctgctccttctcgctgactgcggtcagggcggccaggtaggcctggttctggcgacgggccagctcgccgttgtcgctcaggtagcccttggaagtggcgtagttctgcagttcatggctcaagggcgagagggttttcagggccgcggaaaaggcctgggccgcctgatccacttccgggatcggcgtatcgatggccagggcgccatccagggcccggctcaggcgatcgatgagaatatcgttgccaatgctgaaggcagtgatcggcgccttgcccgccagggccggcacctcgtactgctggtaacgctggaggaaggtctggaaggattcgctgatgctgttcgccgcaccgacgtactggttgtatttctctatttcctgttgccgggtatcgacctgcgcgacgggctggctgaccttttcactcttgtcgccacaaccggccaacagcacggtgccgcccaacagggccgcagccaaaaacatccgggtattcattggttcattcctttaaaaacaggccacgaccaaccgcacggcagcgacagaccggtgacggggttggatgggcacaacaggggattgacggcaggtgtgccgtgtcgatcagccgcccctgatctggggcgtaagaatcatccatgagtaactcgcgaaaaggcctgagaattcgtcagacgcatccatttccggggcaggcattgtgcgagacttcccccgtcctggcaaacctcgggccgccctggcctgcccctcttgcgcgaaatgccgcgcttctgtgatagcgatcacaccctctggcagggtatccagagcccattcgtcgattcccgggcacttatcggcctttttcccgccccaacttcaggtacccattgccaaaggagagccctcatgcctcgtggaagcaaagccaaatacaccgccgagcagaagcgcaaggccgcgcatatcgaagccggctacgaagccaagggcgtgcccaaggacgaggccgaagcgcgcgcctgggccacggtgaacaagcagtccggtggaggggaacgggctggcggctccgggcaacgcacaccggcctcggaaaaaaccgccgcgcgccagtcctcggccaggcgtgccgtcgccagccgtgaaggacatgcccgcaacagcacggcgtcgctgagcacccagacgaaggacagcctgctgaaggaggcccgggtgaaaaacattcgtggccgctcgaccatgagcaagcaggaactgatcgaggcattgcgcaaggcgggataaaccatggatcgcgagcaggcctactcccggcgggaacgagcttgctcgcgatcgctcagtcggcgaacgcctaggctcgcacgccatccccatcgatcagcgcatccacctccgctgcacccggcgcggtggccggcccccagcgggtcaccgccagggccgccgcggcgttggcccggcgcgccgcctgcagcggctccagcccctgcgccagcgctgcgacaaagactccggcatgggcatcgccagcgccgttgctgtccaccgcccggaccttgaagcccggcacatgggcgctatggccatgctggctgacccagcaacccttcggcccgtccctgaccaccagcaacacctccggcgacagtccgtcatgcaggcgtcgcagggcttcggcgatggtcgaggtcccggtgaagcgcaaggcctcgacgctgttgctggtccagagatcgatacgcggcagcagccggcgcatggcctcggagtccggcgattccaccagcgggcccggatcgaacaccacctggatcccctgcggcaaggccagcagccagtccagcaaagcctcggccttgccgacatgcagcaggctgtagccgctgacatagacaaagtcatcggcctgtaccgcgacaccgtccaggtcctcggccgacagctggccttccaccccgatgtaggaaatgaagctgcgttcggccgtggcttcggtcagcgccacgcacaggccggtgtcctcggtgtggctggcctcgagagcgatccggatgccctcggcgcgcatcgcctcacgagccagatctccgaagcgaccgttgccgtgtcgccccaggtacagcaccggcaagccgttacgccgggcggcagccatcacgttgaagccgccgccggcctcgaaactggcggattgcgccagcacatcgccgccggaactcggcaggcgctccacggacatcaccagatcgacgataacctggccggtgtgcagcattctaggcattggcgttctcgacaaaagcgccgcggcggtccctggccccgcccagcaccgcatacacaccaccggccaccaggaaggtgacgatccagcccaggccgttatggcccagccaggaatcggccagcggcccggcgaaccagacgttttcggcggtggtgccgatggtggtgaagctgaaacccagcactatggccagcgcccaggcaccgaaggcccgccattcgaccccgccgcgataccagtaggcactgctcgggctgacgtccagcaggtccttggggctgtagtagtgtcggtggatcaggtcgaccacgaagatcccgacccaggcagtgatgggtaccgccagcagcgaaatgaaggtgatgaacggcccgtagaaactctcggcgatcagcatgaagtagatcgagccggcgaagatcgccacgatgtctaccaccaccgcgtacacccgcttgaccttgagccccagggtcagggtggtcaggccggccgagtacaccgacaggttgttcgacagcagcaggccgccgaaagcggtgatcaggtacggcaccgccatccaggtcggcagcatgtcgcgaatcgccacgatcgggtcggtggccgaggccaggtcatcgttgcccaccgacagcaggccgcccagggtaatcagcaacaccagcggaatgccggcaccgaaggccgccgacgccaccaggcgcgcggccttgacgctgcgatgctggtaacgcgacatgtcggcgccggcgttggcccagccgataccggtgcccgcggccatggtgccgacgccgatgatcatcgcgctcaacggcgccggggtggcgttgaacaccacactccagtcgatggtggcgcagaggaagccgcctaccagcaggttcagcgcgccgaatacataggtggcccacttctggatcaccaagagggtcgcgtggccgaggccggagacggccagggtcagcagcacgaaaacgccgatgaacagcagggtcagcagcggcgcactcttggcttccaccggcgagccgaacaggatcgaacacagcgacagcaggacgaaggcggcggtggtggtattaacggtttcccagcctaggcgcgacatcagcgacaccagggtcgggccgatattgccgcgcacgccgaagatcgcccgcgacagcgtcaggctcggcgcccgcccgcgacggccggcgatggagatgatccccaccaccgcgaacgaaccggcggcgccgaggatggcgacgatgatcgcctgccagatcgacaggccacgaaaggccaccagggtcgcccccagcggcaagccgagaatgctgatattggcggcgaaccagacccagaacaattgcagcggatggccgttgcactcgccttccggcaccggctcgatgccgcgggtttccaattgcccggcgctttgcccggggttcgatgcactcatgaaaaagctcctgttgcccttgttgtgattgtcggcaatttcggaagtcgatcagacatcccggcactcctcgccgtttcctgctatccatggcaaaaatgcttcagcgacggctcgcgcacaggtggtgggagccttggccaggcaaccagtctttaacgcagggccagcagcccctgcaccagaggttcgagatccaggtcgttgacctgcttgatctgctcgatcaaggcggccggccagcactccatcccctggcaggcaccgagcatcgcgccgaggatggcggcaatggtatcggtgtcgcccccaaggctcgcggccatgcacagcgcctcgaacgcctgcagttcaccgatggccacctggtgcgccagggcaaaggacaccaccaccgattcctgggacgcgacggaggtgccgatcacgtcgtacagcagatcggccagcagcgccttgtcgctttcgacgctgagggtgcgcgcccaactgatgcgcgtggcaatacgcccgccagccacccagtggccatgccgctctgcttcctgagcgatctgcacgccgatctgcaaggcgtcgcccagcggcacgccgttgatcccggcggacaccaccgccgccaccgccgccgcgctggagatacccagcgtagtgttatgggtgacctggcaagcttccaccaccgcgcggatgaagccctggacatcgtcgacattcgccgcgatgcccaccggggtgatgcgcatcgccgcgccgttggtggtgccgtagcgcccggcctcttccgcggtatggccggcgaggatcatctcgatggcgcgcttggtcgaagggcccaaaaggtcctgggagcccttggcctgcatcgccgcttcccactcgatcaggctgtgggccagcgccgccggttcgatccggcccttgcccgcgaccagcaggtcgccgaccaggatcgcctgctcggtgtcgtcggtgatcgagcccttgggcatgttggcggcaatcggctgatcggggccggcgtcttccaggcgatggatggcgccgaaacgctgcttgatctgctgccggctgagggattgagtcggcatgcccagggcatcgcccaaggccagcccgtaaaaggcgcccagagcgcgatccagcgggatcatttctgcgccccgaattgcaggtgcaggcgaaagtgcaccgggtcgaggaaactttctacctgctccatgaagcgtccgcgacggtcataggtggtccgcagggccttgaggaagacgctgccgaccggacgccccagcaggtgcgcctgttcttcgttcagtggctcggcgccgatccattgatcgccgcgctcgccgatatagccgtaggcggccagggtaatggtcagggaatcatcgatcagccctacccgcggcaggctttccaggcctccggtggcaggcatcagggaacgttcaagggaaaccacggtgccgtcggtagagcgccggcgccggtccagagcgatgaactggtcagtgccgaagcgactgagcaggtcgggacgctgcaccgcttccaggcgcagcagctcggtgttgatcagcgcaccggtgtccgccagggcctgggcccagccgctctgctggtccagcaccacaccgtcataggtgacgatggagccgaccccgctctgggtggcgatgtagttgcggcgtttgagttcggccagggcctcgcgcaaggtgccacgactcaccgagaattcctgggccaactgatgctcgcccggcagcaggaaaccgtcctccatgaggccgctttcgatgcgtcggatcagctcatcgaccacgcgttttttcttgtcaaatcgaacatgtttaatcatgtacaaattgatacccgaaacgggatcttcgtcgcaagatatttattcgggaaacaaggtatttcgcagttcagggctccaggccgatcgggaagaacaccccgccgctccagacgcccagccagttctgaccgtcgatcggacggctcaccgccagctccaccagttggtagaacacattgcggtgcaccagtgcttccaggttgctgcgcacgtgaacgtaaggcgccggctccccggtctgcgggtcgattaccacccgcagcggatgctcgctgccggcgctgacctgctcgtcgacgttggtggtaaagcgcaggacttgggcctcgccttccccttcgacctccagggtgacggcgacaaagggcgcgtcatcgaccttgatgccgaccttttccaccggggtgatcaggaaatagtcgtcgccgtcgcggcgaatgatggtggagaacagcttgaccatgggtttgcggccaatgggggtacccaggtagtaccaggtgccgtcgcgggcgatacgcatgtcgatatcgccgcagaagtcgggattccacaggtggaccggcggcaagcccttctgcgccttgggaatctgcgccaacagatcgttggctttgcccggaccactcatgctgctctcctcgtgcttggcttaatcgctcaagcctaacaggctgcgggcgtattgttcgagcggcgggccaagcaggtcttccggcttgttgtcgtggaacgtcagtaaaccgccacgactgcgaatccgcgcggtgtcgatcagatactgggtactggtctcgatcagcatgatctgaatcacgccgttgtcgatccccaggcgatccacggcttcctggtcgaaccattcatcagagttgccaatacgatcgtcggccttggcgaaacgggtgtacagcaagtaatgcgcacccacctcacgggcctcggccatggcctggtccaggccttccggcgcccgggcgcggcggaccatggggaagtattcgataaagcccttgaaggcttcctcggccaccacgttggggcgcgggtaagcgctacccggcggcgcaaaggcgccctgggcgatgaaaatgaacgagtccggctgaacgcggaacgagttggagcgctgggtattactgtgatcgagaaaacccgcatcgctcatgtgatagcgaacgccctcgcccatatcgctgacattcatgcagccgccgagccccaaaaaagccagcagcaaaaccaggctacgcatccttccctccagaagccggtgacggaaaaccggcgaatggccacgagatgcagcttccgcgccagctcgggcgcctgtagccgctgccgcaggctgcgaatggctgcgcagcagccacaaacctggtgaaggctattggctggagagaaatgggtcgcctggattggcgagggctacgccctcgatcgcagcctgcggcagcggctacagaggacggggatcagggagatcgacgcttagccaccgatgattttcatcaccgtcgcaccaccggagaatgccacatcctgcttgtcgcccaaggctttgaccagtaggcgctgcaaggccggcaaggcttggtggcgcggtttgtccagcagatcgccgacgtaatgccggttactcgacgacaggcaaccgtgcagccagccggtggacgacagccgcaggcgcgagcaggtccggcagaacggtacgctttcgttggcgatcacgccgaaatggccctgccccggaatttcatagcgcactgcggtggcgtccaccggcgcatcggcctgcaggtattcgtagcgctcgccgatcaggctcagcagttgctgcaggctgacgaactgctgcaggaaagcgttggaatcgctggccaggtggcccatgcgcatcagctcgataaagcgcagttcatagccacgctccaggcagtagtcgagcagcggcattacctggtccaggttctgcccgcgcagcggcaccatattgaccttgattttcatgcccgccgcgcgagcctggtccatgccgtcgagcacggtcgccagatcgccgccacgcgcaatgccacggaaagccgaggcgtccagggtatcgagggaaacgttgatgcgccggataccggcatccaccagcaacggcagcttgcgtgcgagcaattggccattggtggtcaggctgatgtcttccagccccatttgccccaccgccgccatgaaggcttcgagtttcggactgaccaggggctcgccgccggtgatccgcaagcgttcgatgcctgctgcctcgatcagataggccacgccgcgcgccatggcctcggccgacaactcgtcctgggcagccaccagccgcttgccgttgggcacgcagtaggtacaggcgtagttgcaggcagaagtcaggctgatacgcagattgcgaaaacgcctgccttgacggtcaacgatcatggatgactccggcgaaggaagagtgaaccgaccaaaacctgactcaaaaatcaggttttggcaagtcccatgcctgagtatattcctgggacactgcgccatatagagaaatcatggcgccataaggccaccgaatgaatcagctgccggagctctcggggtcgcgcttgcgcttgttgcccatgcgcacgccgatgtccatcaggaactggaagaagccttcctggtcttccagtacgttgctccagaacggcgagtgatacagcgccaccgcgccatgcaccagcgcccaggccgcacagtagtggaagtaaggcggtacgtcttcgagcttgccttcgctgatgcggcccttgatcaacaaggtcaggcgttcgaagttggaagcacggatcttgtgcagttcctcgaccatttccggcacctggttacccttgaccaccttctcttccaggcgatcgaacagccggtaacgctgtggatcacgcatgcggaattcgaagtaggcccgggacagggcttccttatccttgtcgacatcggcagagtgcagcagctcgttcaggtcgcgctcataatcgagcatcaggcgcagataaatctccgccttggacttgaagtgcttgtagatggtccctttgccgataccaacggcatcagcgatcatctcgacggtgacgctgtcttcaccttgatcgaggaacagcttgagcgcggtatcgagaatttcttgctcacggcgacgaaactcacggaccttacgaggttctttctgcataagaaaaggtctgtcggggtcaaaatcgaagccgcgtattatgcctaaattgcgccaaaatgcacggatcatccgaccatgactatgtttcttgatgaatttgtacaggcccctggcctgcgttatttgaatcacgcagctgtcgccccctggccgaatcgggccgccgaagccgtggcgcgcttcgccaaagagaacgttttgctgggcgcacgggactatccggactggatggcccttgagcaacgtctgcgcgaacgcctgatgcgcctgctaaatgcaccgtcaacggatgacatcgcgctggtcaaaaatacttcggaagcgctctcattcgtcgcctttggtctgccctgggaacaaggtgaccagatcgtcagcagcgacgaggaattcccctccaaccgtatcgtctgggaagccctggccagccagggcgtggaagtgcttcaggttagcctcaagggcgacgacccggaaggcgccctgctggccgcctgcgggccgcgcacccggctgatggcgatcagcgcggtgcagttcgccagcggcctgcgcctggacctgcagcgcctgggcgccggctgcaaacaacagaacgtgctgttctgcatcgacgcgatccagcaactgggcgcccaacccttcgatgtccaggtctatcaatgcgacttcgccatggccgacggccacaaatggatgctcgggcctgaaggcctcggcgtgttctattgccgcagcgagctgcgcgcgcagctcaagctccatgagttcggctggcacatgctggaacacatgggcgattacagccgcaacgcatgggaaccggccaagagcgcgcggcgcttcgagtgcggcagcccgaacatgcttggcgccatggccctggaagcaagcctgtcgttattggaagaagtgggcatggaacacgtggcgaccttgatcgccgaacgggtccagtggctccaggatggcctgaatgctatccccggcgtacgcctgcacaccccgctcaaccccgcccgacgcggcggaattttttcgttcagtatcgatggcatcgataatcaggcagttcatgaggcgctgcaacagcagcaggtggtgtgtattccccgtggccccggggttagattttcaccgcatttctataccgaaaagcgcgtgatcgacgagactctcgccattgtggctgacatcgcccggcaatgagaactcaagcgaagcgctcgtattccaaatttgtttaagaaacgagcaaggccaactggactgaattcaatagtgatcaatacttgaaatatcggcgtgacatctcccccaagtgaagcgccgatgaaggtaccaagggatggtgtgcctttgttttactcctaatggtcttaacccggattcaccccccagaacccgggttttttttgcctgcgattcagcccttgacgtgcgccagcgggaacagacgcttgaagttctcggtggtctgctcggcaaaacgctcgtacggctccccacgcagcatggccaggaactcggcgacttcacgcacgtactgcggcaggttgggcttgccgcgataaggaatcggcgccaggtacggcgaatcggtttccaccagcaaacggtcggccggcacctggcgcgccacgtcccgcagcgcatcggcattgcggaaagtgacaatcccggacagggaaatgtagaaacccaggtccagcgcggccttggccatgtcccagtcttcggtgaagcagtgcaggaccccggcttgcggtaacgctgcttcacgcagcagggtcagggtatcggcgcgcgcgccacgggtgtggacgatcaccggcttgccggtctgctgggcggcttgcaggtgcaggcggaaggattcctgctgcaactgcgccgcttccggctcgtagtggtaatccaggccggtctcgccgatggccaccacccgcgggtgattcagctcccgcagcagccagtcgagggctggtgctgcgccgggctggacatccaggggatggatacccaccgagcaatcgacgtcgtcataacgctcagccagcgccttgacgtcggccgcattgtcggcgctgacgccaatgcacaggaaatgcccgacaccgcgctgacgagccgcatccagggcggcatccagggagccgtcgtgcgcggcgaggtcgaggcgatcgaggtgacaatgggaatctacaagcataagaagcgacaaccacattcggtcaatgaacaggccggcccgagcagcagccggcgattcggtttgtttccaggcgccgccgtcagttgcgggcaggcagtgcggcccactgcaccagcaaggcttcgagcaacagcacccgattgaggttggccttgttcaacaccttctggcgctgcgcaaggatccagtcctggatctccagaaccttggcctgggaggacttctgcgcgaggtactgcaccactttgcgcatatcggccaatcccagcccctcctcgtcctgcgtcagctgatagcgcaggatcaggctcgaccagtcgcagaaccaatcgaacagcagtagcaagggtatcgcattccaaccttcggccagctgggtcggcgactgttgctgcttgagcaacttcttcaccccgtcgaccacctgcgcccgctgctcgcgcgcgccctgggcttgcaggctgacagccgccaggggcgaaccggccgccagggtcaacagctcgacccgctcctcttccgaacagtccggcagcgccttgctcagccattgcaggctcatggcctcactgggcagaggacaggcctgctgcacgcagcgacttttgatggtcggcagcaaacggctcggctggtggctgaccagcagcaacaccgtatcgccggacggctcttcgaggcttttcagcagcgcgttggaagcgttgatgttcatcgactccaccggctcgatcagcaccaccttgcgcccgcccagttgcgcggtctgcaccacgaagctgaccagctcgcgcacctggtcgaccttgatcgccttgtccgcttcctccggctccagcacgtagttgtccggatggctgccggcctgcagcagcaagcacgacttgcattgcccgcaggcatccagcccggccggacgctggcacagcaggcgcgccatcaggcgctcggccaacgcacgcttgccgatacccgccgggccatggagcagataggcgtgggcatgctgcgctcggcccgccagttgctgccagagttcgtcctgccagggaaaggcctcagccacggtgcagctccagcaatttcggcaacagggcgtccagtgcttgctggacctgggacagcggctgcgccgcatccaccaacaggtaacgcgccggatcggccgccgcgcgcttcaggtacgcctggcgtaccgcatcgaagaacacccggccttccagctcgaaacggtccaggcggccacgggcgctggcgcgggccagacccacttcgaccggcaggtcgaacaccagggtcaggtcgggtcgcagctcaccctgaacgaactgctccagggtcgcgatgcgctccacggacaaaccacgaccaccgccctgataggcgtaggtggaatcggtaaaacggtcgcacaacaccaccgcgccacgagccagcgccggacgaatcacctcggccagatgctgggcgcgcgcggcgaacaccagcaacagctcggtatcgggattcatgacctcgtcgccgggggtcagcagcacctcgcggatccgctcggccaagggcgtaccgcccggctcgcgagtcagcaacacctcgatgccagcggcgcgcaggcgctcggccaggtattcgcggttggtgctcttacccgcgccttccgggccttccagagtaataaacaagccagtcacaggcagtccttaatcaaagtcattgcgggcttttcggctcgggctcgacgggagtttcgagcggtgcttgcggcggtatttccgggctcacttggggagcctcctgagaaggctcttcaggggactcctgcggaactgcctcgggcgccgtatccggtgacgccgccgaggtcgactccggagtctcggaaaccgccgggctgcccgccggtgccgggctggaacgataatcggcgcgacgcttgagctggaactcgcgcacggcattgttatgcgcttccagatcgtcggagaacacatggctgccatcgccacgcgccacgaaatacagactgctgcccggcaccgggttgagcgcggcatgaatcgcctcccggccgaccatggcgatcggcgtcggcggcaagccactgatcacgtaggtgttgtagggggtcgcttccttcagcagggcgcgggtcaacttaccgttgtaacgctcccccagaccatagatcaccgtcggatcggtttgcagcagcatacccacttgcatgcggcgcacgaataccccggcaatctgtccgcgctcctggggcacgccggtttccttctccaccagcgaggccatgatcagcgcctgatagggctcggtataaggcacatcggccgagcgcttgttccattccttggccagcacctcgtccagacggctgtaggctttttccagcagctcggcatcggtcatcccgcgcacgaaacggtaggtatcgggaaagaaccggccttcggggaaaactccgccgtgaccgagcttttccatgacttcactgtcactcaacccattcagggtctgctcgagcttgtcatgcttggccaacgccgcgcgcacctgacggaaagtccagccttccaccagggtcaggctgtactgcaccacttcaccacgctgccagaccccgatcaggccatgcgcggtcatccctggggtcatgcggtattcgccgctgtgcagtggttgtccttccatgttgaagcgccagtacaggcgcagccagaacgcgtccttgagaacgccattggcttccatacggttgaaggtaccgcctggcgtcgagccagccggcacgtcgagcaattgctcttgggtcaggttgagaggctgctccagcgccgagttcaacttccaggccgaggcgcccagcgccagacctgccagaaccagtccggtctccagcagaagcaatagtttacgtctcacaaatcaggcatccagtagcgtgcgggcaatgcgttgcagtttacgggtgagcggtccggccgaccagcgcagtgcgccacaggcaagcaccggccaaatgccatagacactgttgcagacaaagacttcgtcggcctgttgcaactgttcgagactgatgtcggcgatttccgtggggatagccaaggacgcggcctgaaacaatatttcagcgcgcatcactccggcgaccccgcaacggctcagatcggccgtgaacaaggcaccgtcgcgcaccaggaacagattgctgaacacaccctcgatcacccgcccggaaacgtcgagcatcaggccttcggcatgctcgccgtcctgccactcggaacgggcaagaacctgctccagtcggttgaggtgcttgaggccggcgagcaagggctgctcggacaggcgggtagtacaagggaacagtcgaaccccctgctcggcatgcgccgccggataagcggccggcgcattaccctggaggattcgccgcggctgcgcccgcgggtcggcggcataaccgcgctggctatcaccccgggtgaggatcagcttgagcacgccctcccccagcagcgaggcgtaggcggtgagctcgctgcggatcaacgcctgatcggcagcgatggccaggcgcgaacagccctcggccaggcgcagcaggtgccgctccagcaacaagggctggcccgccttcaccgcgatggtctcgaatagaccatcgccataagccaggccacggtccttgagcgacagtacgtcagccggctgaccgtcgacccagctgtccatcagccggcgaaccggcggaacaccagggagccgttggtaccaccgaacccgaaggagttggacagcaccacgtcgatgtccatgttgcgcgcggtgtgcggcacgaaatccaggtcgcaaccttcgtccggctcatcgaggttgatggtcggtggcgctgcctggctgttgatcgccagcacgctgaagatggcctcgatggcacccgcggcccccagcagatggccagtcatggacttggtggagctgatcgccagcttgtaggcgtgatcgccgaacacactcttgatcgcctcggcttcagccaggtcaccggcaggtgtcgaagtaccgtgggcattgatgtactgcacctgctcgacgttcagcttggcgtcacgcagcgcattggcgatgcaacgcgccgcgccggcgccatcggcgggtggcgaagtcatgtggtaggcgtcgccgctcatgccaaaaccgatcagttcggcataaatggtcgcgccacgggccttggcgtgctccagctcttcgagcaccagcgcgccggcaccgtcggacagcacgaagccatcacggcccttgtcccaaggacggctggcacgggttggctcgtcattacgggtcgacagtgcgcgggatgcgccaaagccgcccatgcccaggccgcaggcggccatttcagcgccaccggcgatcatcacgtcagcttcgccaaaggcaatattgcgggccgccatgccaatgcagtgggtacctgtggtgcaggccgtggaaatggcgtagttcggcccctgggcacccagatggattgacaggaatccggaaatcatattgatgatcgagccaggcacgaagaacggagaaattcgacgcgggccggaatcatgcagcgtgcggctggtttcctcgatattggtcaaaccgccaatacccgaccccatggcaacgccgattcgctcgcggttggcatcggtcacttccaggccagcattacgcactgcctgaaaaccggccgccaagccgtattgaatgaacaggtcgagcttgcgggcctctttgaccgacaggtattcctcgacattgaagccctttaccgagccgccaaaacgggtggaataggcagaaaggtcggtgtgttcgatcagaccaatgccactgcggccagccagaatgccctgccagctgctcggaacatccgtacccagtggcgacaacatacccataccggtgactacgacgcgtctacgcgacacagcactctccttttttctaatgacgacactttgcatcaggcctaaagaaaaaaccgcacgccgtaacggcagtgcggtttttccatgacagcaaaagacgactaaatacgattaagcctggtggctggtaacgtagtcgatagctgcttgaacggtagtgatcttttcagcttcttcgtcagggatttcggtctcgaattcctcttccagagccatcaccagctcaacggtgtcaagggagtcggcacccaggtcttcaacgaaggaagcggtgttaacaacttcttcttctttaacgcccagttgctcagcaacgattttcttgacgcgctcttcgatggtgctcataccttgttttcactcctaatggacaaattcaggcagctggccagtgggtaagtgtatagaaaggcttttcagcttttcaactgaaagcttcactcctcaaaccctttggccacctgcctataaattgattgcagctttataacggattttagacagctcgtatgacatttttttgaagcaatccgtcacatttaactcacatgtacatcccgccgttcaccgggattgtagccccggtcacgtatgccgcaccgtcggatgcaagaaaagcgaccacttgcgcgatctcttgagcctgccccagacgacccagcggaatttgtgtttgcagcgcttcacgctgcgcttcaggcaagtcgcgggtcatgtcggtatcgatgaaacccggagtcaccgagttcacggtaatcgaccgcgagccaacctcacgcgccagagcacggctgaaaccttccagacccgccttggcggtggcgtagtttacttggccagcgttgcccatggcacccaccaccgaaccaatactgatgattcgaccccagcgagccttggtcatgccgcgcagaacgcctttggacaggcgatacagactgttcaggttggtatcgatcacgtcgtaccactcgtcgtctttcatgcgcatcatcaggttgtcacgagtaataccggcgttgttcaccagaatcgccggcgcgccgaactgctcctggatgctggccagtacggcagcaacggattcgtcgctggtgacgttgagctcaaggcctgcgccctgaatgccgttttccttcaaggtggcagcaataccctcggcacccgaagcggaagttgcggtacccacaacgatcgcgcccaggcgacccagttcaagcgcgatggcctggccaataccgcggctggcgccggtaaccaatgcaactttaccttgcagactcatgcaggcttctcctaattcagaccaaggctgcgcgagcggcagcgaaggcatctggggtgttcaggttagaggtcgatacgccttcggcgcagcgcttgttgagacccgccaggaccttgcccggaccgcactcgaccagctgggtagcgcccttggcggccagggtctgcaccgactccacccaacgcaccggcttgtacagctgctccagcaggtcgcgcttgagggtttcgagatccggcgccacatcggcgctgacgttctgtaccaacagaatctgtggcgcctgccagttgatggcggcaatcgactcggcgaaacgctcggcagccggacgcatcagctcgcagtgtgatggcacgctgactggcaatggcatggcgcgcttggcgccacgcaccttgcaaccctcgatggcgcgctcgacagcggccttggcgccggcgatcaccacctggcccggggagttgaaattgaccgcgctgaccacttcgccttgtgccgcttcggcacaagcggccagcacatcggcatcttccaggccgagaatcgcagccatgccgccctgccccgcaggaacggcttcttgcatcaactggccgcgacgctctaccagcttcacggcttcgcccagagtcaggctgccagcggcaaccagcgcactgtattcacccaggctatggccggcaacgaatgccgggcgcgccccgccttccgccagccacagacgccacagggcgatagaggcggtcagaatggccggctgggttttgtcggtttgattgagcagctcttcgggcccctcttgggtcaaggcccagagatcgtagcccagagcatcggaagcttctttgaaggtttcgaggatcaacgggtactgcgcgcccaactcggccaacatgccgagggactgcgagccctgtccaggaaagacgaatgcgagggatgcagacatgtaacaagcccctaatgatcttgtcgtcggagaattgacgccgcaccgtggtggacgcaagaaactgagagttggatggccaattgaactgagcggtcacatttaagcatttccgagtgcaaacgcctaaagcaacagatcttcgagccgcccatgcaggcgctcagggaggttttcctggatctcgatcaacgcccgttgaatcgcactctggaagccctgaacccctgccgaaccgtggcttttcacgactattccctgcaagccgagaaaactcgcgccattgtgtcgcgccggcgccagatcggcctgcaggcgccgcatcagcggcagcgccagagcaccgaccacacgggaaaccgcgttttgcttgaacagggattcgatacgcgcggcaatcatggtcgccagcccctcgctggacttgagcaggatattgccgacaaaaccgtcgcataccaccacatccgcctcgccgcgatacaatccgtcgccctcgacaaaaccgatgtaattcagaccccgggcattctgcagcaggctagctgccagcttgacctgctgattgcccttgatgtcttcagtaccgatattgagcaacgccactcgcggacgaacgacccccagcgtctcggctgccaccgaccccatgaccgcaaactggaacaggtgctcggcgctgcaatcgacgtttgcccccagatccagcagctggcaatagccgcgctgggttggaatagccgccaccatcgccggacgatcgatgcccggaagggttttcaacacataacgcgacaacgccatcagcgcaccggtattgccggcgctgacacaggcctgggccttgccatcacgcagcagctctaacgccactcgcatggaggagtccggcttgccacgcagagcctgggaaggtttttcatccatgccaatgacttctgcggcgggcacaaccgtcaggcgcgcgcgatccacagccgaatgaccggaaatcagttcttctagaaggaaaggttggccgacaagggccaggtgcagcgagggggtggcagacaggcaagcaaggctggcctgaacaatgctgcggggaccgaagtccccgcccattgcgtcaatcgcgatgacttgagcggacaaggattactcgtcagcgcccttgtcgatcactttacgaccacggtatacgccttctggcgatacgtggtgacgcaggtgaacttcaccagtggtcttttctacggacagggtgctagcctcgagagcgtcgtgcgaacgacgcatgtcacgggcagagcgggattttttgttctgctgaacagccataattgattaactcctaaacgtttgggtcacgctttaactgcgccaatacactgaacgggttggaccgcgttacctcgtcctcgctcggttcgggctcatcgagacccgccggctgctggcattcttccggatgatgagcaggcacgatgggcaaggcgagcaaaagctcctcctcgatcaaagcctgcagatccaaaggatcttcgcccagttccagcacgtcataacctttcggcaacgactgggtattcgcaccctccttcaccacagcgtaactgcattcgctgtggatcggcagggtgaccagctcaagacaacgctggcaaaccattttgacttcagtgtcgataaagctgtggatcaccacagatttacgttcatctcgttcaaaaacgaatttagcctgcaccgtaccgacatcgtcggaaagcgggtcgcagagtctcttcaaatcggccagcagcagttcaccttgaagggtcgtgccacggtcagccaatttgcgcgggtcaacgtgaggtggaatcgggtcattcaacataggcgcagcattatagggatgcccccggccatgtcaaaggaaattcagccctgtccgtcacttgcaagccccgctagaattcgcggccagcctcaggagatgcgcatgctgcctttattacttgcctcaagctcggcctaccggcgcgaattgctcacccgcctgcgcctgccattcacctgcagctcaccggatatcgacgaaagccatcgccccggcgaatccgccagcgacctggtcaagcgcctcgccgaagagaaagcccgagcgctggccaccacccacccgggacacttgatcattggctcggaccaggtcgcggtgctcggcgagcgcatcatcggcaagccccacactttcgaaagggcgcgcgagcaattgctcgccgccagcggcgccagcgtgacctttctcaccggcctggccctgctcaacagcaagagcggccactgccaggtcgactgcgtacccttcaccgtgcatatgcgcgagctgagccctgcccgcatcgaacgctacttgcacgccgaacagccttatgactgtgccggcagcttcaaggccgagggcctgggcatcagcctgttccgcagcaccgagggcagcgacgccagcagcctgatcggcctgccgctgatccgcctggtagacatgctgctcgccgaaagcgtagaaatcccctgaccacccacactaaaaagccggccatagggccggctctttttaaaacagcgcaatcaacgcagtgtcggcccctgaaagcccatccacatggccagatgctcggcaacactggcacccagttttttcgagaagcgatcgaaaggcgactcctgcacggtgaaatccaccaactccttctcgccgaccacatcccgggcaaccgagctggcactccccaacccatcgatcaagcccagttgcagtgcctgctcaccggaccagaccaggccggagaacagctccggatgatccttgtccttgagacgctcaccacgcccctgcttgacgctggcgatgaactggcgatgagtggtatccagcacaccctgccagaactgggtttcctcgggcttctgcggctggaacgggtccaggaacgacttgtgctcacccgaggtgtaggtacgacgctccacacccagcttctccatggtaccgacgaaaccataaccggccgccgtgaccccaatggaaccgaccaggctcgccttgtcggcatagatctgatcggcggcgctggcaatgtagtaggcgccggaagcccccaggtcggaaatcactgcatacaccttgatatccggatgcaagccacgcaggcgacggatttcgtcatagacataccccgactgcaccgggctaccgccaggactgttgatacgcagcacaatgcccttgaccttcgagtcctcgaaagccgcacgcaagccggtcacgatgttgtcggcgctcgccgactccttgtccgcgatcatgcccgtcacctcgatcaacgccgtgtaaccggccccgcgggtggcggttttttccatatccatcaacggcgtaaacagcgccagggccacaagcagataaacaaaggtcaggagcttgaagaaaatcccccagcgccgcgaacgccgctgttcttgcacaccggccaacagggtcttttccagcaatttccagctcttgtcgtcagcactgtcggcagccgatttactcggcgctttccattcgtcgctcatgcttttaccccaaaagactcaattgccccgccggccaagccaggcatgcaattgaggaaaactatcgatagacaggcgcggctcgtaagcctgcaaggcttccagcgattgcgcgccataaccgaccgcaaccgatgccatgcctgcattacgcgccatcagcaggtcgaaagaggaatcaccgaccatcaacgcctgctcggggcgcacctcgcaatgcgccaggatctgctcgagcatcaacggatgaggcttgctcgcggtttcgtcggcagcgcgagtgatgtcgaaataatcttcccagccatgcgccttcaacacccgatccaggccacgacgcgccttaccggtcgcgaccgccagatgatatccctcgcgccggaaagcctcgagagactgcaccactccggcgaacaacggagaaggctcagactcgagagcgatgtagtgatcggcatagtgctgacgaaaatctaccagctcggcatcgctgatgtgcggatacagcgtgcggatcgcctccggcaatcccaggccgataatgcccttgaccgcaaaatcgtcgcaccgggcaaaccccgagcgatcggaggccacatgcatggcctcgactatccgaccaatggagtctgccagggtgccgtcccaatcaaagatcagcagtttgtaatcagggtgcactcaggcgctccacggtcttggcccacatttcatccaccggtgcctgcaatttcagctcgccgccatcgggcaacggcacggtcagcatgtaggcatgcagaaacaggcgcttaccgcccaggtcgcggatttccttggtgaaatcgtcatcgccatacttgctgtcgccggcaatgcaatgcccggcatgcagggtatgcacacggatctggtgagtacgaccggtcaccggcttggcttcgaccatggtggcgaagtcaccgaagcggcgcagcaccttgaacacggtcaaggcctccttgccctcttcgttcacttcgaccatgcgctcgccggaacgcaggttgctcttgagcagcggcgcacggacctgcttgatcgaggtcgcccagctgccgcgcaccagcgccatgtagcgcttgtcgacaccatcgccgcgcaaggcttcatgcaaatgacgcagcatgctgcgtttcttggcgatcatcagcaggccggaagtatcgcggtcgaggcgatggaccagctccagctccttggcgtccgggcgcaactgacgaaaggcttcgatcaccccgaaattcagaccgctgccgccatgcacagcgatgccggcgggcttgttgatcacgatcagggctttgtcttcatagacaatcgaagcctccaggcgctgcaacaaaccctgcgccacgggcacgggctcgtcacgctccggcacgcgcaccggcggcacgcgcacgatatcgcccgcctgcagcttgtattcgggcttgatccgacccttgtttacccgtacttcgcctttgcgcaaaatgcggtaaatcaaggtcttgggcacgcctttgagccgagcgaggaggaaattgtcgattcgttggccggcatattccggcgagacctcaagcagttgaacgcctggggtcagggggcagtagtcgtcatggcgcaaatgataacaattttttatggaattgaagcacttaatgattactgctatagtcgcgaacgccgccaaaagcggcctggacagcggaccaacggccaacagccggccctgaccaacgcaattcaccaggatgcgaggccgtcctacggggctttcgctacgaacggtggagttttgcagttgtaacaagcgcaggtgacatgaggcctgaagcacgccgaaaagcagagtttccactcgcctatcgagcaaatattcacggccagttcacaaagtgcagtcagctacgaacgaacccgagcgagcgcttcggaaacaccgcctaaattagccatgatgcgtgagctcccctttcggagctcacggtaaatgccaacccgctgcggattctgcgcgcggcagcacccgaattatcagggatacgtgtagggtggagatgcacaaccgtcggactgtgtagcattaggctttatcaagacgcttcatctcgtccacagtcgccggttgattcctcctcctgattgagcttttgcttaagaggtgccttttgtcaccccagcaagcaggacgcgtgagtcgcgagttcgccccagctggccggatttcgctagacactggagcggccaaccgctcctgacgcacctgacaccgaccgtgagaagtcgtgtgtgccgaacgccgtttccggcagcccggaaaccgacggtactacatgaaaagaatgctgattaacgcaactcaacccgaagagttgcgtgttgcactggtagatggccaacgcctctacgacctggacatcgaatccggtgcacgcgagcagaagaaggccaacatctataaaggccgtatcactcgcatcgaaccaagcctcgaggctgcctttgtcgatttcggctctgagcgccacggcttcctgcccctcaaagaaatctcccgcgaatacttcaagaaagctcccgaaggccgcgtcaatatcaaggacgtcctgagcgaaggccaggaagtcatcgttcaggtcgaaaaagaagaacgtggcaacaagggcgctgccctgaccaccttcatcagcctggccggtcgttacctggtgctgatgccgaacaacccgcgtgccggcggcatctcccgtcgcatcgaaggcgaagagcgcaacgaactgcgcgaagccttgaacggtctggtcgcccctgccgacatgggcctgatcgtccgcactgccggcctgggccgtagcagcgaagaaatgcagtgggacctcgactacctgctgcaactctggaccgccatcaaagaagcctcgctggaccgcgcggcgcctttcctgatctaccaggaaagcaacgtgatcatccgcgccatccgcgactacctgcgccaggacatcggcgaagtgctgatcgacagcgttgaagcccaggacgaagccctgaccttcatccgccaggtgatgccgcagtacgccagcaagatcaagctgtatgaagacagcgttccgctgttcaaccgtttccagatcgaaagccagatcgaaaccgccttccagcgcgtcgtcgaactgccttccggcggctccatcgttatcgatccgaccgaagccctggtgtccatcgacatcaactcggcgcgcgccaccaaaggcagcgacatcgaggaaaccgccctgcagaccaaccttgaagcagcggaagaaatcgctcgccagctgcgcctgcgtgacatcggcggcctgatcgtcatcgacttcatcgacatgaccccggccaagaaccagcgcgccgtggaagagaaagtccgcgaatgcctggaagccgaccgcgctcgcgtccaggtcggtcgcatctcgcgcttcggcctgctggaaatgtcccgccagcgcctgcgtccatccctcggcgaaagcagcggcatcgtctgcccacgctgcaacggcaccggcatcatccgcgacgtcgaatcgctgtcgctggcgatcctgcgcctgatcgaagaagaagccctgaaagatcgcaccgccgaagttcgcgcccaagtgccgattccagttgctgccttcctgctcaacgaaaaacgcaattcgatcaccaagatcgaactgcgcacccgtgctcgtatcgtcattctgccgaacgaccatctcgaaacgccgcacttcgaagtccagcgtctgcgtgatgacagcccggaagccggcatcaaccagtccagctacgaaatcgccgctgccgctgccgaagccgaagaagtccagccagccgccgcgacccgcaccctggttcgccaggaagccgccgtcaagaccgctccagcccgtgccaatgcaccggttccaaccgaagtggtcgccgccccggttgccgctccggccgctgttgccgagccaagcctgttcaagggcctggtgaagtccctggtcagcctgttcgccaccaaggaagagccagccgctccggtcgtggttgaaaaaccggccaccgagcgtcctgcacgcaacgaagaacgccgcaacggtcgtcagcagagccgtaaccgcaacggtcgccgcgacgaagagcgcaagccacgcgaagaacgcgcccctcgtgaagagcgcgcaccgcgcgaagcccgcgaagagcgtcagccacgcgaagtccgcgaggctcgcgaggaagtccaggccaccgctcgcgaagagcgcgcgccacgtccgccacgtgaagagcgtcaaccacgcccaccacgtgaagaccgcaagccacgcggcgagcgtgaagaacgcgtgcgtgaactgcgcgaaccgctggacgctgctcctgccgctgttgctgccgccgaagaacgcccggctcgtcagccgcgcgaagagcgtcaacctcgcccaccgcgtgaagagcgtcaacctcgcgccgaacaggccgctgccgtagctgaagaagagctgctgccgaacgaagagcaactgcaggaagacggtcaggagaacgccgagggcgatcgtccacgccgccgctcccgtggccagcgtcgtcgcagcaaccgtcgcgagcgtcagcgtgacgccaacggcaatgtgatcgaaggttcggaagaaaacagcgaagagccaagcagcgccgatctggccgcaggcctggcggtaactgctgccgttgccagcaccgtgatcagcgccccggctgaagcccaggctcacgagcaggccgaacgtgccaccgccgccgtccaggaagccgcaccgaccgtcgaagcaccggtcgtcgaggccaccactgcggtagagattccggcagcacctgctgttgaagtcgcccaggttcgtgaagaacagcacgaagaacaggctgcgcaacctgcaattgttgcagaacaacctgcagtcgttgccgagccagtggtcgaagcgccagtcgccgaagcaccagcggcagagccaacccaggaagcgcctagtgccttcgagcgtgccgccgaggcgatcattgccgaagcgcctgcgccagtcgcagaagttgtggctgaagcagtcgtggctgctgaacctgtagttgccgagcctgtggctgccgcaccggcggcgccggttgaggcacctgccgccgaagtggctgcaccggttgtcgaggccgctccggccagcgccctgaccagcaccggtcgcgcgccaaacgacccgcgtgaagtgcgtcgtcgcaagcgcgaagccgagcgtctgcagaaggaagccgaactggctgccgctgctgccgctgaagctccggcagaaaccgtagtggccgccgagcttgcgccggtggttgccgaggtggtcgaggctgctcctgctgccgaaccgatcatcgagcaacctgcgcctgccgccgacgaagccccgcgctccatcgaagaagtggtagagcacaagcccaaggcccaggaagaagagcacgagcctaaacccctcgtctgattcctagcccgataaaaagccccgcctggtcacccaggcggggctttttttaggttcttcacggaatcccgggaaacacagaaacaagaacgccgatttgattgatgatgttcgtgcgagcaaacacatctaacaaaccggcgttcttatgcgtgatattaatactttccttcccttttgggagggcttttctgtcgtcacgatcaagcctgatggtgacgcgctccagatcgatctgattccccacgccacccgattcccttcctgtggcggctgccaaaaactctgttcaaccacgcatgagtactgccagcgagtcatccgcgatctgcccattcttggccgagcagtgcgcctcagcgttttgcttcggcgtgtcggctgtcgggactgtggcaaacgcatggaggccgtcagttggctggatcgctatgcccgcatgacgcgccgcctggccgatgcggtcattcaggcctgcgagcgccttcccacgctacacgtggcccaactgttcgggttgcattgggacagcgttcgcttgctgggaacgtcgcgccttgcaagcggcattgagtgttttgccaaaggcgcagccacagcgcttggtcatggacgaatttgccctgttcaaaggtcatcgttacgccagcgtagtgctggacgccgatacccggcgagtgctgtggattggcgaaggccgcagccgggcggcagtcagaccctttttcgaagagctggggtcagagggttgcgctcgcatcgaagcggtggcgatggacatgaacactgcctttgacctggaggttcgtcagcactgcccaaaagcgcgcgtggtctacgacctcttccatgtggtggccaagtatggtcgagaggtgattgatcgagtccgcgtcgatgaagcgaatcggctacgtcacgacaagcctgcccgcacggtcatcaagcaggcgcgatggctgttgctgcgcaatcggcagaacctgaaaacgccggaacaacaagtccgcctggaggatctgctggcggccaaccaagcgttgatgacggtctatttgatgaaggctgaactcaaaacgctttggacaccgagcaccgcctggggctggcgatcagcctggcgacaatggctgcgccatgcgcatgaaagcgacataccgcctctgatccagtttgccaaacgactgaagggttactggcggggcatcgtcagccgggtgcgctggccaatgcatacgggccagttggaaggcatcaacaatcgaatcaaggtcatcaagcggatggcgtacggttaccgggacagcgaattctttttcatgaagatcaagagcgtctttcccggtaatccgtgaagaacctttttttatgcctgcaattcttcgatcaacatcttcgccgcgaaagcgagcccagcgatctcaatcggtaaaaaccaacgcctgcggcgtatccacgtcccacaacacgccagcatccgccagttccacctcgacaacctgccccgcggcaaacaatggcctggctccccgatccccggaaaggccctgcaacgcctgaccaaaggccgcgccaaaagccaccgggtgaccataggcccccttataaacaggcacccggatcatttgctcgcccagttcccgcaccacgctctcgatactcgacggcaggataaagggcatatcccccagcaccaccagccagccactggcatcggtgcaggctgcggcggcggccgcgaggctgtcgcccatgcccggcgaatccagaagcaccacctggcagccataggcttcagccaaggcaatcacctcggtacggtccggcgttgtcaccaggactctacgggccagcaatgcgggcaagctcctcaggacctgctcgactaccggcctgatcaccgcatctcgtcccaggcatggagccagcaacttgtcttgcccgccccccgccgcctgtcggaaacgactgccctgccccgcggccaggatgaccgcgcacagcgactcgctcacgcgctcacctgcgcagccacttggggcggctttttctgcaacaggtcgatgccgttcttgatggcaacgatctccgacatcaccgacagggcaatctccgccggtgtatgactgccgatatgcaggccgatgggcccgtgcaagcgttcgatggcctgcggctccagccccagctgggccagattctcccgacgcttctgactattgacccgagagcccagcgccccgacgtaaaacgcccgggaattgagcgcggtcaacagcgccatgtcatccagcctggggtcatgggtcagcgcgacaatggccgtacgctcgtcagtctcgatattcagcaccgcatcgtccggcattcccggcacaaaacgcccgtgctgctcttcccaaccgtagacaaactccttgcgcggatcgcagatcagcacttcgaagtccagcagccgcgccatttccgccacataccgcgacaactgcccggcgccgatcagcaacagccgccagcgcgggccatagatcgcccgcagggtggtgtcatcgaagctcagcacgtcggttttgctggccggctttagcagcacttcaccgctgctcaggttcaactcccgggcgacgatttcatgcgcctcgcaacgagccagcagttccgcgacccaggccgggtcgccaacccgctcctcggtcaggcgtaaggtgccgccgcacggcaggccaaaacgcgcggcctcctcgcgggtcacgccataagtcaccagttgcactggcggcccgtccagaggcaggcggccatcgtgcaaacgggcgatcaggtcgtcctcgatacaaccgcccgagaccgagccaatcaccatgccgtcttcgcgcaaagccagcatggcccccggtggccgcggcgcgctgccccaggtctggaccacgctgtacaaggtcacgcgctgccccgcgcggcgccattccagcacgctgcgcaggacattcagatcaacgctgtccatcaggccttgctcgcttgttgccagccttgcagctggtaacgcactggcaggttgcggatgcgcttgccggtggcggcaaagatcgcattacacagggccggcgcgatcggcggcacgcccggctcaccgacaccacccagcggcacatcgcctggtggcgtcaccagatgcacggcgacttctttcggcgccagggacatgcgcgccacttcatacatatggaagttgtcctgctggaccttgccgtccttgaagctgatctcacccaccaccgcattgcccaggcccatcacacaggcgccctcgaactgcgagcggatacgctcgggattgatctgcggaccgcagtccacggcgatatcggccttgtgcacgatcagggtgccatcatccttgacctcgacctcgatcaccgccgccacataggtgacgaagctgtagtgcaccgccagccccaggccgcggcccttgggcaggctgcggccccagcccgccgccttggccgcggtctccagcacgccgcgcatgcgcgcggtgtcgatcgggtaacgctccggcgactcgccgtagttccattcttcgctcaaggtccgtgggtcgatctgacgatccggccccagcagtttgagctggtacttcaacgggtcctgacccgccttgtgagccagttcgtcgacaaagctctggatggcgaaaccgtgggggatgttcgacaccgagcgataccagccaacccgggtatgcgcggcggcctcggggttttccaggcgcacgttgggaatcgcgtaggccaggttggtaaagcccatgcccagctcgaaggcggcctcatggttcatgcccggggcgaacagcgcagtgatgctcggtgccacggtgcggtgcagccagccggacggcatgccgtccttgttcaggctggccttgaggtattccgccgacacggtgtggaagtaggagttgtgaatgtcgtcttcgcgggtccattgcacccgtaccgccttgcccggcatttccttggcgaggatcgccgcctcgaggatgaagtcgggcttggatttacgcccgaagccaccgccgagcaaggtgatgttgaccgtcaccttgtcgaagggaatgcccaggcgctcggcgatacgttcgcgggtcacctgtggcgcctggctcggagcccaggcttcgcactggccgtcctggaagcgcgccacggcgaccatcggttccatcggcgcctgcgccaggtgcggcaggtagtaggaggcctccaggctgctgtcggcgctgctcatggcgtcgtcgatattgccagtgctgcgcactaccttgccgggcttgagcgccgcggcttccagctccttgcgataggcgatcgagtcgtagccggcgttgacgccatcgtcccactcgatcttcaacgcatcgcggcccttgatcgccgcccaggtattgctggcgatcaccgccacaccacccagcggctggaactcggaaggcagcggacggctttcgatctgcaccaccttgatcacgcccggcaccttcagcgccgcgctgccatcgaacgatttgaccttgccgccatagacccgtgggcgtgcaaccgtcgcgaagagaatgccgtcgaaatgcacgtcggcgccgtagaccgcctggccattgacgatatccgcaccatcgatggcgcgggtgccctccttgccgatgtagcggaattcgctgggttgcttcaggcgcaggctgtcgcgggccggcaccgccagggcgctcgccgcggcggccagggcgccgtagcccagttcacggccgctcggctggtggatcactttatgcagctgggcccgacactcggccagcgggactttccattgttcggccgccgcctgctcgagcatggtccgcgccgccgcaccgcagcgccgcatcggctcgtaccaatggcgcatgctgcgcgaaccgtcggtgtcctggttaccgaacagcgcctcgtcgcccggcgcctgcctgaccttcaccagcgcccagtcggcctccagttcgtcagcgaccaccatgctcaggctggtacgcacaccctggcccatttccgaacggttgcagagcacggtcacgctgccgtcggcggcgatgctcacgtacaccttggggtcatcgacccagccgttgggcatgccgtcggcaccgaacttcttctcttcggcgaaagcgtcctgccagccccagctggccgccagcaccagtgcgccggtggctccgacgcctttgagaaaaccgcggcggctgaggttgctcaaggcaaaatcattcggcagctggctcatgccttggcctccttcaggtgggtggaggcctggcggatcgccgtcttgatccggttgtaggtgccgcagcggcagatgttgccgaccatggcggcttcgatctgttcgtcactggggttggggttgaccttgagcaaggcagtggccgacatgatctgcccgccctggcagtagccgcactgggccaccgcgctgtccagccaggcctgctgcacgactttgccgaccgggtcgctgtgcaggttgtcgatggtgctgacgtcctgcccgaccaccgagccgatcggcgtgatgcaactgcgcgccggggcgccgtcgatatggatggtgcacgcgccgcacaggcccatgccgcaaccgaacttggtaccgttgtagcccgccacgtcgcggatagcccagagcagcggcatgtcctcggtgacatccagtgggtgatcttgaccgttgagtttcagggtaatcatgggcacgcccgcatattttccgtttatggggtcgagcaatctgccgttgagtacaacgacttgcaggagcagatcgactcaggctaatgggctctcttatgaagacgggggagtcttcaccgggcctttggggtacaaatagttgcattgttagcaggctaagttaagccgcaattaacaaaaaagccttgcagggtgtgaacccgtgcaaggctttgctggcgcgccttgagcttagctcaacgggctcaatagagattgggctccatctccagctgaacatggaagcgctcggcaatatcctgctggatccttcgtgccaggcttaacagctgcaagcccgtggcaccgccatagttgaccagcaccagcgactgcaaacgatgcaccccggcatcgccatcgcgaaagcccttccagccagcctgttcgatcaaccagccagcggccagcttcacctgcccgtccgcctgtggataacccaccagccccgcatgctgctgcctgatctcggccgccagcgcagcggacaccaccgggttcttgaagaaactgccggcattgcccagtaccgccgggtccggcagcttttcgctgcggatgctgcaaatggcgcgactgacatcgctggccgtcggctgctcgatgccctgctcgctcaagcgctggcgcaccgggccatattccaggtgcagatgctcgctgcgggccagggcaaaacgcacccgcagaatcagccagcggccggcctcttgcttgaacaggctgtcgcggtaggcgaactgacattcttccaggctgaagtcgcgcaactcaccgctctgccgatccagagcggtcaggccggcgaacacatccttgatctcgaccccgtaggcaccgatgttctgcatcggtgcggcgcccacagtccccggaatcaggctgaggttttccaggccgcacaagccctgttgcaaggtccactgcacgaagggatgccaggtttcacccgcttcggcttcgactactacctgctggccatcgtcgctcagcagacgaatgccacgggtactcatgcgcaagaccagcgctggaatatccgcggtcagcagcaagttgctgccgccgccaatcaccagcagcggcagttggtactgctccgaataggccagcgcctcacgcacgtcggcgtcgctgtgggcctcggcgaacagctgcgcgcgcacatcgacgccgaaggtgttgaagggcttgagggaaacctgggactgcagatgcaagctcatagccgccccttcagctcgatcaccagccggtcgctggcgtactcgatcaggtccagcacctgctcgaaaccttgctcaccgtcgtagtaaggatccggcacctcgtccaccgccgcctcgtagcggcgcaggaacaggtccagctcggccttgccctgggccggctgcagcgccttgaggttgcgcaggttgctctcgtccatggccaggatcaggtcgtagcgagcaaaatccgcgctgctgacttgctgcgcgcgctgggccgacaggtcgtagccgcgcaacagcgccgcgcgctggctgcgcttgtccggcgccttgccgatgtgccattcgccagtccctgcggacgcgacttcgacccggtcggccaaccccgcttcacgtaacttgtggcgcagcacgccctccgccgtcggtgaacggcagatgttgcccaggcagacaaacaaaacccgcatcaggcctccagcaggcgacgaacgcgctcaaggtcttcggcggtatcgataccaccaggcggcgcttccagggcatcggcgacatggatacgcacgccgtgccacaaggcccgcaactgctccagtgactcggtgttctccagccagcacgggccccagttgacgaagtcatgcaggaagccggcgcggtaggcatagatgccgatatggcggcgatacggcacgccttccggcagcaagtcgcgattcttcgcaaaagcatcgcgcgcccacggcaaggtggcgcggctgaaggtcaacgccagaccattgatgtcgctgaccaccttgaccacgttcgggttgaacagggtctcgacgtcttcgatcggctcggccagggtagccatgctcgcttcggtgtgggcggccaggttggcggccacctgatcgatcaccgctggcgggatcaacggctcgtcgccctggacattgaccacgatggcatccgcggccaggcccaattggttggcgacttccgccaagcgatcggtacctgagttgtggtcctcgcgggtcaacaccgcttcggcaccgaagccctggcaagcctcgacgattcgcgcgtcgtcggtcgccaccaccacgcgctgggcggcgctcttgcaggcctgttcccagacgtgctggatcatcggcttgccggcgatcaagtgcagcggtttacccggcaggcgggtggaggcgaatcgggctggaatgacaacggtaaaggctgtggtcatttatccaggcgctcgtcggtgctgagggtgcgggcttcgctttccagcatgaccgggatgccatcgcgaatcggataggccaggccggcgcccttgctgatcagctcggtcttgtcggcgctgagcttgagcggtcccttgcagatcgggcaagcgaggatatcgagcaatttggtgtccatgagaattccctggatagaagcgttaaggcagaagacgagcgggcaacaggcgcatcagctgcgtatcgaaccaggccacgaaggccggggatggcacagcatccaccgccaggtaccaccagtcgggagccgcgaaggcacggcacttcaccgcatccttttcggtcatgaccagcggcagcgccggggtgaaactcagcgcctgcgcgctgtattcggcgtggtcggcgaaagcatgcgggacaggctgccagtgtagcgtttcaagggtagtgaagaaacgttgcggattgccgataccggccaccgcgtgcaatgcctgtcccggcgcaaagtgctcaagcccgcgacgttcgccgctttgcagattgaccagggcggtgggcaccaggcgaaaggcgaagccatcctcgcgatcgtcgctggcgccgttgtagagcactgcgtcaacgctttgcaggcgctcgaccggctcgcgcagcggcccggccggcagacaacgccggttgcccagcccgcgcgcggcgtcgatcagcaccagctcgaggtcgcgggccatgcggtaatgctgcatgccgtcgtcggagagaatcagatccagcggctcggcggccagcagggctcgcacggcgcgactgcgatcagggtcgatcatcagcggcacgccgctgcgctggacgatcagcaaaggctcgtcgccggcgacagcggcgctctgctcggcggtgacccgccatggccactgcggcggcttggcgccgtaaccacggctgaccacgccgacccgcagcccgctgcgccggcaatgctcgatcagccacaggatcagcggcgtcttgccggtaccgcccacggtgatattgccgaccaccaccagcggcaccgacggctggtaaacattgctctcaccggccaggaagcgttcgcgcttgcgcaccaccacccggcgatagagccactccaggggctgcagcagtttcagcgcgggatggccgttgtaccaggcagcgagcaaacgatcggacatggccatcagggtgctggcgccgcctcgacggtggtcatgcgcagatggctgaaaccgagcttgccggcagcgtccatcgcggtaatgacggcctggtgctgggccttgccgtcggcactgatggacagcggcaggttggtgttacccgccgactccttctgcaaggcttcgatcaggctggccaggtcgctcttgggcagcacctggttgttcaccgaaaacaccccgtcggcgctgatggcgatatccagttgcttggtctgctggtcttcggccggcgagccgctgacggcctccggcaattcgacgcgcaactgggtttcccgggtaaaggtggtggtcacgacgaaaaacagcagcaggataaacaccacgtcgatcaacgacgcgaggttgatatcgatggtttcccgtggcttgcggcggaatttcacgctttgccctcggccagatcgacatcgcggtcgccctgcaccacttcgaccagcttgatggcttcctgctccatgcccaccaccagctcatcgacccggcgttgcaggaaacggtggaagaacactgccgggataccgaccatcaggccggacgcggtggtgatcagcgccttggagataccaccggccagcaccgcggcgttgctggtcatccccgagcccatgaacgagctgaaaatatcgatcatgcccagcaccgtacccagcaagcccagcagcggggccatggcggcgatggtaccgagggcattgaggtagcgctccagttcgtggatgacccgggcggcggcttcctcaatgcactctttcatgacctcgcggccatgcttggagttggccaggccggcggccaggatctcgcccaggggcgaatgggcgcgcagttccttgagcttgtccttgttcagctgtttgtccttgatccagcgccacacctggcccagcagatgaggcggggtaacgcggctggcccgcagggtccacagacgctcggcaatgatgccgaccgcgacaatggaactcagaatgatcggcaacatcatccagccgccggatttgaccaattcccacacagtgacagtcccctcgaaaaagtgcgccactctaacataggggccgaatgcaccgaagaacctgatgtcgcatgccttcaggctttaataactctcggttatttaaggagatagtggccatttgcgccaaaagcgccgctgcgcccgcaggctcgtcggttcggtgtaagtgcccagcatcagctgcagcgctccctgctccgcgctgtcgtaaatggcggtcccttgctggcgataacgttcgacgacctgcgggtgcggatgcccaaacccattgccgtgcccacgggagatcagcaccgccgaaggcgcaagggccttgagcagggccgcggacgacgaactgcggctgccatggtgcggcgcctgcaaccagtgggtctcgacggccagcggggtatccagtaaggcgcgctcggccagggcatcgatatcccccgtcagcagcaaacgctcgccctgggcctcgacctgcattacgcaagacttctggttaccgttctgcgcaccagcccattgccacagggaaaaacgcaccccgtcccattgccactgctcaccgctggcgcaaggctctgccggtaaataggccggcaaaccctcgggatcgccgctgaccagcctggccaccggcaagccgcgctggatggcgtcggcgccaccggcatgatcggcatcggcgtggctgagcagcatcaggtcgaggcgcgcgacgcccagcttgcgcaaggacggcagcactacccgcgcgcccaggtcggaatcgccaaaacgcggaccggcgtcatacagcatcgcgtgctcgcgagtccgtaccagcaccgccaggccctgcccgacatccagctgccagacttccgcctcgccatatggcagcgtgtttttcggcgggaacaccaccaacagcagcatcggccagcccaagggacgcagcggcacgcccgcgggcagcaacagcagcaaggctcccagcgcgctgatgctccaggcccagagcggtatggccggcgctacccaggccggccactgggcagccagcagggtcaggccgcgaaacagcaggtccagcaagccaccggccagccagagcaaaccttcgcccaggtaaggcaccgccagcaacaaggtgccgagcaacgccggcggcagcaccagcaggctgatccagggttccgccagcagattggccagcggcccgctgagactgatgggcaaccccagcgccagcagcaccgggcacaggccgatggcgatcaaccattgaatacgggtccaggactgccaccagcgccagccccccaggcgcccgccaaagatcaggatcagcaccgccaccgcggtaaaggacagccagaaccctggctgcaggctggccagcggctcgaacaacagcaccgcattcaatgccagcaagaacggccaccaggcgcccaggtggcgaaagcgcaggcgccagatcagcaccagggccaccatcacacaggcacggcgcaccggcacatcgaaccccgccagcaacccgtaccccagggccgaagcgaacgccagcccgcaggcccagggcagccagggcctgcgtccgggccacaggccgtagcgggccagccccgccaccagggcgtacatcactgcggccagcaagctgatgtgctgcccggaaatcaccatcaggtgcacggtcccggtgtcttgcaagacacgccagtcttcctggctcaagcccgagccgtcgcccagtaccagggccgccaggccgccggcgcgcccgtgggcatcgacttgcagcaagcgctggcgaatgcgcgcacgccaactctcccgggtagcagccagcaattgcccatccttgaccgtacccgtggcgccgatgcgctgggccagcaaccaggcctcgtgatcgaaggcctgcagattgaccaggccggcaggtcgcttgagcttcaccgccaggcgccagcgttcgccgctgtgcaccggcggcccgccgtaccaggccaggcgcaggcgttgcgggatccgtccgcgccgcgcccgcccgtcttccagctcgaaacgcaccagcccctcggcctgctgcggcagccccaccacccgcccttcgagccagcgagtctgcccgtcgagtggttccgccaaacgatcatccagcgccgattgcgcgctgatgcaggcccacgccaggcccaacagaaaaagcgccaatggataggtgcgaaacggcaacagcatcaaggctactaccggcagcactgccaaccatccgatcgctggcagcgccggcaaaaagcgcaggctcaaaagccccgccgcaaacgccagcatccctgtgcgcataagcccgtccttgagcagtttttgagtgttcccactctctggcttagctcagcggaccggggggcggctttatcatttgtcacaaagtctgaatgggcgccttctagaatccgggcatacttgccgcttgaactgaccgagaagccttatgccccggcgcctattcaaacgttacatgccagatccgaccagcatcagggaacacaagtccttacgctttcttggcacgttgctgcatgaccccaacctctggcacctcaaccggcactccgtggcgcgcgccatggcggtcggcctgttcgcggcctttatgccgatcccggcgcaaatgctgctggcagccgtgctggccatttccgtgcgcggcaacatgccgattgccgtgagcctggtctggctgaccaacccgatcaccatgccgccggtgttcttctgcacctaccagatcggtgcctggttgatgaacgtgccggccaggaccctgcccgacgagctgacctgggaatggatcagcggcgaactctcgaccctctggcaacccttcctgctgggctcgctggtggctggcctggtgctgggcgccctcgcctattgcctgacgatgctgtactggcgctggtgggtcagccggcaatggcgccgccgcaagcagagccggctgtagaaacgcaaacggcctcccgagggagcccgttgtcgtttctgcgcgggcttactggcgcatgccgcgaccgctgaccagcaggcgggcacaaccgaagtacaggaccacggtcgccaccagcatgaaggtaatggccacgctgatctggatgtcggaaaccccgaggatgccgaaacggaaggcgttgaccatatgcagcaccgggttggccagcgacaccgtctgccagaacggtggcagcagggtgatggagtagaacaccccgcccaggtaggtcagcggggtcagcacgaaagtcgggatgatcgagatatcgtcgaagttgcgcgcgaacaccgcgttgataaagcccaacagcgaaaagatcgtcgcggtcaggaccaccaccagcaaggtgatgcccaggtgatgcacctgcaggtgggtgaagaacagcgacagcagcgtcacgatcacccccaccgccaacccccgcaggacaccgcccagggtgtagccgatgaggatggtgtgcggcgacaccggcgacaccatcaattcctcgatggagcgctggaacttgctgccgaagaaactcgagaccacgttgccgtaggagttggtgatcaccgacatcatgatcaggcccggcacgatgtactccatgtaggtgaaaccacccatgtcgccgatctgccggccgatcaggttgccgaagatcacgaagtacagaaccatggtgatcgccggcggcagcagggtctgtggccagatccgggtaaaacgccggacttcgcgatagacgatggtgttcagcgcgacaaggttgggccgtagctcggaactcataccgccaccttcgacaggtttttctccaccagggacacgaacagctcctcaaggcgattggttttgttacgcaggctcagcacttcgatgttttgctgggccaactggctgaacagcgcggtgatgcccacggctttgtcgacctggacttccagggtgtggctgtccagaagcttgcttggataaccgatcagttgcggcgccaccttcaggtcggtcttcaggtcgagcaggaaggtttccacatgcagctggctcagcagctgacgcatgctggtgttctcgacgatggtgccgtggtcgatgatgccgatattgcggcacagctgctcagcctcctccaggtaatgggtggtgaggatgatggtgatgcctttctggttcagctcggtgaggaaggtccacatcgaacggcgcagctcgatgtccacgccggcagtcggttcgtcgaggatcaacaggcgcggctcgtgcaccagggcgcgggcaatcatcaggcggcgcttcatgccgccggacagcgagcgcgacggcacatcgcgcttgtcccacaagccgagctgcgtcaggtactgctcggcccgctccttggcgaccttggtcgggataccgtagtaaccggcctgggtcaccacgatgtcgaaggtcttctcgaactggttgaagttgaattcctgtggcaccacgccgatgcaacgcttgagcgcggcgggctcgcggtccaggtcatggccgaagacattcaccgtgccgctggtcttgttgaccagggtcgagaggatgccgatggtggtggatttgccggcaccgttagggccgagcaaagcgaagaagtcaccttcggcgacatccagatcgataccactcagggcctggaaaccgttgccgtaggttttggttagctgccggatggacagagcggaactcatatcggatttacgcaccaagaagggagaacattataagtaagggcggaccgcctgcattgcaacggcgccggatacacccaatggtgcttgccgacgccgcacaagtacagtcacccgtattgatagtcagtattaagtcaacgcggtcatcaccgccttgcggtaggccggacgctgttgcaggcgggcgtaccaggcttgcagattagacaattgcgggcgctcgatgggcatttcgaaccaggcataaatgaagctgcccagagggatatcgccgatgccgatttcctcgccggacaggtagggatgttcggccagggcctggtcgaccacggccagcagttcgccgcagctgttcagcgcggcattgatcttgtcccagtcctgctgctgtgccggcgtgcgcagcacaccccagaacaggtgccggaagggttcggcgaagatcgaagtggtccagtccatccacttctcggccgaggcccgcgcctgtacatcgctcgggtaccaggccgtaccggcggcatggcgcgcggcgagataacgcacgatggtgttggactcccacaacacgaagccgtcgtcctcgatcagcggaatccgcccattgggattcatcgcccgatattccggggtatccaccacaccgaaggcaccaccggcatccaccgcttcgtaggtcagcccgagctcttcggcgcaccacaatgctttcctgacattcgacgagtttttccgaccccagattttcagcatgaccgctcctcagtgatgaatgccgaggcagtctacgccggatcagacctgactcaaatcactctgcatgtcgcccagcagcaacggcatctgctcggcaaacagatgcggataacacttttccaggtgtttgaagaagaaggtctcggggacgtcggcgaattgtccgtggtccagcacgtactccatcatctgctcgccctggcgattgaagggatggaacacgctgtcatgacggccatcgaactccagtggcgccacatcgtacatctcgcagagtttccggttgaacgccggcgtggccttgacccagcgtccttgcaggtacagctcggtatagccgtgcatggcaaacacgtcactgcgcagcaattccagcaaacgcggggtcgacaggtgattgcgcacgtccgccaggccgatccgcgcggcgatcccgcaatgccgcgcgcagccggcaagcagggtggccttgggcacacagtaactttcgcccgcggccagggcatggctgccacgcagggtctctgggtcgcgactgaaggtgtaggggttgtagcgcacggcctcgcgcaccgcgtaatagaggcttaccgcctgctccagcggatcgctgctggcgccacgatgagtttccgcgaactccaccaccgcggggtggtcactatcgatgaagcggctgggactcaggtactcgtgcatggggatgatctccgagtgaagtcccgagtctagcgacggcctcatcccagcgataacgacgtttcggccaaatatcagaggctgccgcttcgagcctgacaagatcgacacgctgctgacccgatgcctgacgtctgcgtccgcttcttcttaccgctgcaagcgcactgccctgtcaccccttttgtcggatgccgactaagctctgtgggtgattttgcccctggtttcacggaggattaaatatgctgttgttgtggatactggttctgctggtcggtattgcctacctggcccaccgccgcattgcgcccctgcccgccctgggcgtggtggccgtctacctgctggccatgggcgccttcagccgtgcaccgggctggctgctgctgatcttctgggtactgctggccgcggtggcggcgcccttgctactgcccgacctgcgccgcaagtacttcagcgccccgatgttcagctggttccagaaagtcctgccgccgatgtcgcaaaccgaacgcgacgccatcgatgccggcacggtctggtgggacggcgaactgttcagcggccgtccggactgggacaagctgttggcctacccgaaagcgcagttgagcgaagaggaacaggccttcatcgacggccccaccgaagagctgtgcgccatggtcagcgactggcagatcggccagtccatggacctgccgcccgccgcctgggagcacatcaagcaacacggcttctttgccctgatcatccccaaggagttcggtggcaagggcttctccgcctatgcccactcccaggtggcgatgaaactggcgacccgtagcggcgacctggcgtccaccgtgatggtccccaactccctcggcccggccgagctgctgctgcattacggcaccgacgaacagcgtaaccactacctgccgcggctggcccgtggcgacgatatcccctgtttcgccctcaccggcccgctggccggttccgacgccggcgccatgcccgataccggggtgatctgcaaaggccagtggcaaggcgaggaaaccctcggcctgcgcctgaactgggaaaagcgctacatcaccctgggcccggtcgccaccctcctcggcctggccttcaaggcctacgacccggaccatctgctgggtgacgatgaagacctggggatcagcctggcgctgattcctaccgacacccccggcgtggaaatcggccgtcgccacctgccgctcggtgctgccttcatgaacggcccgaactccggcaaggacgtgttcattcccctggacttccttatcggcggccaggaaatgctcggcaagggctggatgatgctgatgaactgcctgtcggtcggccgctccatttccctgccggccgtcggcactggcgcggccaagttcaccagcctggtgaccggccaatatgcccaggtacgtgagcagttcaacgtcccgctcaatgccttcgagggcatccaggaagccctggcccgcatcggcggcaacgcctggctgatggacagcgcgcgcatgctcacggccaatgcggtcgacctgggggaaaagccttcggtgctgtcggcgattctcaagtaccacctgaccgaacgcggccgcgagtgcatcagccacgcgatggacgtgcacggcggcaaggccatcatcatgggcccgaacaactacctgggccgcagctggcaaggcgcgccgatcttcatcaccgtggaaggcgcgaatatcctctcgcgcaacctgatgatcttcggccagggcgccattcgctgccatccgttcgtgctcaaggaaatggccctggccggtcgcgaagaccacaatcaggcgctggtcgaattcgacggcctgctgctcaagcacatcggttttgccgtgggtaacgcggccagcaccctggtgctgaacctgggcctggggcacttcgaacaggcgcaaggggacaagctcagccagggttatttccgcgccctcaaccgccaggccgcggccttcgccatgctggccgacctgagcatgatgttgctgggcggcgagctgaagcgtcgcgaacgcctgtcggcacgcctcggcgatgtgctcagccatatgtaccttgcttccgccgcactcaagcgctaccacgacctggattcgccggagcatctgcggccgctgttcacctgggccatggaagaaagcctcggccagtcggaacgggccctggacgaactgctcgagaacttcccgaaccgagtactgggttgcctgctgcgggtggtggtattcccgttcggccgccgtcacaaaggtccgtccgatgagctggacgccgaggtcgccgcgatcatcggccgggccaagggcgacccgaccctggaagaactgctggccggctgctaccgcccacaatcggcgcaggacccggtcggcgccctgcaacacgccttcgacttgttgagcgccagtcacccgctgcagaaaaaactgcacgaggcgctgaaaagtggccaggtcaagccggtgaccggcgaacatgccatcgacgccgcgctggaggccggcgtgttgcagccggtggaagcccagaccctgcgcgaggctgaagccgcccgccgcaaagtcatcgatgtcgatgacttcgccaaagaagagctgaccctgagcgaagggaaaacccgctaaggcgcaggaccgtcaggcggattatgaaaccgggcgcgggagctatatactcccgcgcccgttttgctgttgaggactcatgtcatgtccaacgtcgtcgccgatcatctcgtcctgctcgaccatttgcgcagtatcctggtcgcggtgggtgaagccgagcaggttcccgaagaaagccatgccttgttcctggaacgcttcgacgaactgcgcgcctcgctgccgatcgacccgatcgaaagccagtacctgggccaggatctgctgtgccaggtgatgcagcgttatccacaggtcgcccatctggtaccgcgcgacctgctgtggttcttcgctggggattgcctgcactacatgcccgacgaggaaatcgacctgtaccaggcgctcgaagagcgtcgctacgaggccgagcagaatgatgaaccgttcgactggaaccaggaaaagcaactgctggcgctctctgcccaggacagcaagcactgagtccggcccggatgctacaaaggcccgcacggttgaaccggcgggccttttttctggttcttcacggattaccgggaaagacgctcttgatcttcatgaaaaagaattcgctgtcccggtaaccgtacgccatccgcttgatgaccttgattcgattgttgatgccttccaactggcccgtatgcattggccagcgcacccggctgacgatgccccgccagtaacccttcagtcgtttggcaaactggatcagaggcggtatgtcgctttcatgcgcatggcgcagccattgtcgccaggctgatcgccagccccaggcggtgctcggtgtccaaagcgttttgagttcagccttcatcaaatagaccgtcatcaacgcttggttggccgccagcagatcctccaggcggacttgttgttccggcgttttcaggttctgccgattgcgcagcaacagccatcgcgcctgcttgatgaccgtgcgggcaggcttgtcgtgacgtagccgattcgcttcatcgacgcggactcgatcaatcacctctcgaccatacttggccaccacatggaagaggtcgtagaccacgcgcgcttttgggcagtgctgacgaacctccaggtcaaaggcagtgttcatgtccatcgccaccgcttcgatgcgagcgcaaccctctgaccccagctcttcgaaaaagggtctgactgccgcccggctgcggccttcgccaatccacagcactcgccgggtatcggcgtccagcactacgctggcgtaacgatgacctttgaacagggcaaattcgtccatgaccaagcgctgtggctgcgcctttggcaaaacactcaatgccgcttgcaaggcgcgacgttccagcaagcgaacgctgtcccaatgcaacccgaacagttgggccacgtgtagcgtgggaaggcgctcgcaggcctgaatgaccgcatcggccaggcggcgcgtcatgcgggcatagcgatccagccaactgacggcctccatgcgtttgccacagtcccgacagccgacacgccgaagcaaaacgctgaggcgcactgctcggccaagaatgggcagatcgcggatgactcgctggcagtactcatgcgtggttgaacagagtttttggcagccgccacaggaagggaatcgggtggcgtggggaatcagatcgatctggagcgcgtcaccatcaggcttgatcgtgacgacagaaaagccctcccaaaagggaaggaaagtattaatatcacgcataagaacgccggtttgttagatgtgtttgctcgcacgaacatcatcaatcaaatcggcgttcttgtttctgtgtttcccgggattccgtgaagaaccttttttctacccatgagcggctggctcaacccgctccatcgccttcgggttgttcgtagcctttcgcctcctgcttgccctgccggctcaaggtcggctccttggccaggcactccaccagataatcgatgaatacccgcagcttcggcggcaggtagcgggttggcgaatgcaacagccaggcaccgccatggtaggaagcgagaaacgtccagtccggtagaacctgtaccagcaagccctgctccagggcatgccgcgcggtgaagtacggcaagctgccgatgccgatatgctccagcaccgcccccagccgtaccccggtgtgattggccgcataacgcccacgcacaccaaccgtcaccgacttgctgcccttcttgaacttccagcgcgcatcgctgggggtttcacccaggtaaatgcaactgtggttgagcagatcgtggggatggctgggcgtcccgtgctcggccaggtactgcggcgtggcgcacaacatgtgatcgatggtcagcaattggcggccaaccagccccgccggcggccgatcggtgatgcggatggccaggtccacgttgtcgtcgatcagatcaatgttgcgatcttccaataacagctcgacatcgaccttggggtaacgccgcagaaactcgggcatgtacggatgcacgacaaaacgccccacggccttgggcacgctgacccgcaccagcccttcggcctcgtgggtgaactgaccgctgatttccatcaccgacttggcggcgctgaccatctcgctgcagcgcttgaacacctcctcgcccccttcgctcaagcgcaacttgcgcgtggtgcgttgcagcaagcgagtcgccagcgccttctccagacgggaaatgctgcggctcaccgccgacggtgacgagcccagctggcgggcggcttcggagaagctgccgacctcgacgaccttgacgaaaatcgccatttcgcccagcagcggaaggggaagatttatgctcacagcacaacagtcctttgaggtttgaacggattatcacgcaattccgccgcgccatataattaaaaaaggtattttaataagggcacggaatatgacgcttcgcctcttttttcataatgatgaactcaaggccaacgttgaagtgctcgaatgcaccccgcaggacaacgaattcgcggtgatcctgcgcgccacgatctttcatccccaaggcggcggccaaccctgcgacaccggctggatcggcgaaagccaggtgttgcgcgtggtccaggaacccgagcgaatcattcattacgtcagccagccggtgcaaccgagcatggtccaggtccaggtcgatgaacagcgccgccagttcaatacccgcatgcactcggccgggcacctgatcggtcatttcggcgaaacccgcggctgggtcccggtcaaggcccatcactggcctggcgagggccgcgtgtccttcaagcccggggacagtccgcaggaactcgacgtcgacagcctgcagagtggcatcgatcactggattgccgccgacctgccgcgcctggtctcgctgcgtgaaggctcgcgggaaatcggtttcggcgagcttcccgcctatggctgcggagggacccacgtgaagcgcctgaaggaattgggcaacgtcactatcgcctccatctcgcagaaaaaaggaatgctttcggttcactaccacgtggactgattcatcggcggtgtcgccttgcacatcacgcgacgcatcgcctgacacaggggaaacccgcgtgcgcgggttcgacgattatcggatagagggatctgcagatgatgcttgacgtcgagcgtctcgatgagacgtgcataaagaaactggcccaggaacaagtgctcgccctgcgcatcaagaatttcctgccgcacacccaggcgatccagctgggtgacaagattctcgctcccggcttcgagggctacatcaacgcccccagcatcgggcggatcggcatggcgttttatgaggcggaaaatcagccgctgctgatcgaagactatttcgaacgcgccaccgccaacatcgccgaactgcgcacgcgttgcgcgccctatgcgtctcccgtcgacaccctgcgctgcatgctcgacgagtcctggccggccggcgctcacctggaaaacctgtacgggcgcaagatgtacgttggcctgtcgcgggtagtgaaacccggggtgtgcttcctcgcccatcacgacattttcgccaaggacgcccccgacagcttccaggcccacagtctggaggcacagttcgcctgcaacctctacctgaacatgcccgatgcgggtggcgccctgcagatgtggaatcacgatatttccccggaccagttcgacgacatgcgcggcgacagctacggcatcgaccccgccctgctcggcacaccctcgctggagatccgtccggagcccggggatttcatcatgttcaactcaaggcgcatgcacgcagtcaccccgggggtggccaacccgcgcctgagcctttccttttttgtcggctatcgcggcagctcgtcccccctgaccttctggagttgaaatgctttccaactatctaggcgaattcctggccctggcgaccatccactttctcgccgtggtggctcccgggcctgactttgccgtgaccatccgccagagcgtgcgctttggccgggtggtcgggctgtgtacggccatcggcatcggcgcgggaatttccgtgcatgtgctgtacaccctgctgggggtcggagcactgatgcacaccacgccatggctgctgaacgtggccaaggtggtgggcggtgcctacattctttatctcggcgttagcctgttgcgcagcaaacccaagacatcgatcgagggcagcgacacgaacaacgatcaggtgcagcggcagaccttgcccaaggccttcatgaccggtttcctgaccaacgccaccaaccccaaggccacgctgttcttcctggcgattttcaccacgatgatcagcgccaccacgcccctcaaggtgcaggcgctctacggtgtatggatgtgttgtgtgaacgcgctgtggttcgtgatcgtcgcgctgttcttttccagcccgagggtgcgcttgctgttcatgcgcatgggccactggttcgagcgaaccatgggagtgattctgattctgttcgccgggcgcctgatcctgtcgatgtaagtcgcaccccaacgtcctgctcaagcgagccgccagcaactggcggctcgacacaggcttgctcagttccgatccacgatcagctggcggatgacaaagcctgaagcaagactccctgcggttttgccatttcgtccagtactgaaaagtgcgtgcagcccggcacgtgaatcagttgcacagactctcctcgggccaacgcttgctgggcgtattcatcagactggcggaccagttccgacagttcgtcggcacctaccgccacccatgtatgggcgcccttgtcgatatggtgcagcgggctataggtgttgatctccgcttccgagagactcagtttctggttgagccacgacaggcttatgggttccaggtcgaccagtgcgctgatcgccaggacatcggtcacccatgggtgcgaacggaactggatcgccaggtggcctccagccgagtgcccgctcaggaccaccttatgccccgcaatacccaggtgatcaacgtcggcctggagatgctcgagcaggctgccaatctcgctgacgatctgtgtcatcgaggcttgcggcgcgagcgtatattcggccaggacgacgttgaaccccgcagccaggggaccggcggcgatgaaggcgaaatcttccttgctgcaattctgccaatacccgccatggatgaagatgaacgtcggggcgttggctttgccacagggcaaccagtcataacgctgcctggaaccggtgccgtaaggcagatcgagccgaccggccacagaggcatagaaactggcgctacgcgcctgcagggctgcgtagataccggggaaatccggcactgcctcggtgttgttatacgccgcgtcgagctgggcttgattcatgtcgcgatagagaatggtcatggtcatctccgatggaaggaatgtttaaaagggcttggtcagcggcctgcggttcgtgcggacgtgtccgtcatccggcaggtttcaggagagcggcttcgctgtccacggctgctctctgtgagaggagtgccacgcgtggttggggactgtaggcagggtggtgtgcggaacgcggctcgaatgcgttaaagaatgagtggagcccaggtcagacgtaaatcagccgaatcttaaatttctctaagatttatcctgccatggccgccctgagcgaacggcgcaatggcatatcaaagtgaagcgcgaagatattcagacgggggctatgcaggccagcgcgatgctggaggcagcaggcttcaaggcaggtatgacggtgtatgaaggacgcatcacgctatctggagcagcatcggtgcttttctagcccccccggcgacgagtgcaaaagccggcgctgagtgcgtccggcccgctcagtcagcgccgccatcgtccgggatggaatgctcggaatactgtcctggtgaccggttcgtcgcgctcaagcccgcgcaggggctcgttgagtattctccagggcctgcctcagcacctgctgggtcagaggcttgaacaccacctcatccatcccggcggccaggcagcgttggatttccgcgtcctcggcactggcggtcgcccccaggatccagcagcgccggcgaccgtcctcacgctccatctggcggatgcgcacggtcaagtcatagccgcccaggcgtggcatctggctgtcggtgatcaacacatcgtactcggcggccaaccaggcttcccacgccgcctgcccatcctcgaccagcgtcacgcgatgccccagaaccagcaattgctcttccagcgtcagccggctgaacgcattgtcctcagcaacgaggatattcagcgaaagcggctccatgctcgcctgcggtacttctgccgcggcttcggcaggcgcctcggccaggggcagttgcagggtcacgctgaagcaggagcctatatccggttcgctgctcaggacgatagtgccgcccatgagttcgaccagccgccgggtgatattcagccccagcccactgccaaaggtttgcccgacctgagccgaactgacctgggagaatggctggaacaatctggcctggtcctgctccgagatgccgatcccgctgtcgatgacctccagcaacaggtgcagatgttctgcctcccggctgcccgaggcatgcagcgtcacccggccgcgctcggtgaacttgatggcattgctcagcaggttgaacagcacctgtttcaaatgcagcgggtcgatcagcacccattgctccatgtcgccggtgaaccgcatctcgaacgccagctgcttttgtcgcgccatgccgaccaccaggggctcgatcgcttcgatctgggccttgagctgcaccgcctcgggcgccgagtcgatcatccccgactcgatccggttcaggtcgagcacattgccgagcaacagcagcagcccctgtgccgcctcctgcgcgacggccagcgacgccaggtccagctcaccccgttcggccttttgctgcaccacttcctgcaggccgataatggcgttcagcggggtacggatctcatggctcatggtggacaaaaagatgctcttggcctcgttggccgcttcggccttctctcgcgccagcgccagctcgccttcggcctggcgggtcttgcgcacctgccgggtcaggtagaaaccccagatcagcgacaacaggaccagcaagccgaagacaccgccgagccggaggacgttgccgcgatgatcccgccagaaatggctgcccaaggtagaagtacgcggttcccaccgctccacgatgtccgctacctcctccggggtgatcgccacctgagccttctccaggatgctgcgcagttcttcctgccccttcagcaccccaaggctgaccggtcgggagaactcgtcgagaatgccgattacgcgcaagcggttgttgaaacgctgggcggacaggaaacgaccggtgtagtcactgccgatgaacgcgtcgctacgcccgtcatcgacactgcgcatggcctccagaaagttgggatagatctgtaagcggatatccggatagttctgctggatgatctggttaacgaaataacccgggacgctggccaggcgcttgccttgcaggtcattcaggctatggaaagggctgccctgggtacgggctgccttgggtccggccatcagtaccaccgagctcctcagataaggaagaaggatatccatataggcctcggtgtcggtgtcggcagacgtaaccgaggtcatcagggtcttgccctcggttatctgcgcgttcatctcggcataattctgcgcgcggacagggcggaacgtcaggccgctgcgctggctgagcaacttgagatagtcggggccgataccccgcacctgcccactgttgtccaattgtcccaaggcgccgagagagtcatggacagtcaccgggacttccggatgggcgtccagccaacgattttcggcgggggtcagcgtcacgcgctgctgagtcaggcgcaggctgctccccgcactccaattgcgcagaatactttcgctatggcgcgagcgaatggacggcagggctcgttcgatcacggcatgcaggcgagtatcggaggcgcgcaccaggaagccgaaagcacggctttccactggtgcgaagttttcaatgtgcaggtccagcaggtagttgatgttgatcagatagtgggcggacaccgcatcatcgatcaccccatcgacctctcccaggctcaacgcctcgagcgcgcgcagcggcgaagcgaatgacaggatctggctgttcggataaacggcggagaccttttcctcgacacggtagccggcaaacacccccagccgagtgccggttgcctgtgggtcgaaagggtggcgttcggttgtcaccagcacggcttggttcggttcataggcctgggtcagtagcagaccgttatcttcggcatccatcgcggagccaccgccgaccaggtcaatctcaccattgtgcagcgcggtcagcgccgcctgccgggaagggaatcgacggaccttgggagggatctcgaacaacaaggcgaggtaatccgcggtgacgccctggaaacgattgacatcgagcatgcccagcggcggatagtcgggcaatgccaccccgatcgtgagtgggcctctgcttgccagccactgtcgatctacttcactcagccatggccggctggtcactgccacccttgcgacgagggagatgtcaggctcctgtgcggccagaacgggtgatagaacaagtaacaggcagagagcgaccatccgacaacacgctggaatcatggaataccttcctgtgaatcgaaccccggcaacctgcgcaaatgggctgttgtcccacgagcaacagcatcaccctcttatggagagtgccgctttgatctgtggcaatgggggatggatcaagagtgatccgtcggtattctagccgggcgccggcggttgtgacatcgagcggcgcgagcctttctcgactatgcgcgcccttgtgctctgatgggctcgggaaggctggacagcaactggctcgcgatagccatccgatcggggcaggaaacgggccggcgaacagaagaacatgtgcccgccgtcaataatgatcagttgtagttgagaacgaagctcatagtcgcatcgcccttgcccggctttatctcgctacctgtcggaacatatttggcactgccggagaaccggtaaatggagccatcggcagcatccctgttccagtcgagggcgatggatcgggtgatgtcgaacggtagcttggcccctttgtcgttgaccagcgatatacctacccccgttgcgaccccagcctgacccagcctggaaagcttgagcatgccgtcggcctgggagctgccctcgaagtagacttttaccggcacttttgccccagatttcaaccctgtacagcgtacatcgaagttgaacggcacctcccggacgtcaccattcttgatgtgctggatggtttgtttacccatctggacattgactgccgcgcccaccgactcgcatccggaaaaatacacatcgttgaccagctcggtagtgccctgccctctgatctgaagggcagcacctccgactagccaatcgatggtgaacgccataggcacgctttttcctgactctacatcacgactggttcggataatcttcgtcactagatacctagggagaggaaaactccccaggttatgaaccccctggctatagaaaggacatacatcgcttgagtaccagaccaaacagaattgaacgccgaggcctttgacacctgtttcataaactttagttatcgccgatggcttcagtgcagtacggatgctgacggtgagttcctggtaactttcagaacacgtataattctctgtccagagcttggcttcatacctggcaagctcccctccaataggcgtagccttaaccgtagcctgagagggtagaacaacgtccagtgttcgcgaaacactcgggagtgtacaaactgcaaacgcttcccgagcaaacagaccgaataaaaatatcaagaaaaatatcagcttacgcatataacaccctttcccatgccatattaagcgtcacaggcacaagttaataacgctcaagaaaagtgataagaacctaccagtaacactggcgaactgcatggtagtaagttagttatagttaagaacgaaactcatggtcgcatcgcctttgcccggctttatctcgctacctgtcggaacatatttggcactgccggagaaccggtaaatggagccctccgcaatttccctgttccaatcgagggcgatggacctggagatagcgaatggcaacttgacgcccttgtcgctgaccagggaaatgcccacccccgatgcgacccccgcctgacccaaattggcaagcttgagcatgccgtcggcctgggagttgccttcgaaatagacttttaccggaactttcgtatcaggtttcaagccttcgcagcggacatcgaagttgaacggcacctccctgacgctaccccgggtaatatttgcgatggtctgtttacccatctggacgttgaccgccgcacccaccgactcgcacccggcgaaaaacacatcgttgaccaactcggtagcaccttgtgacctggccacaagggatatgttggagtcttgcactacccagttcatgttgaacaccatcggaatgtttcctgaggcaacatcgcttccggtacgaacgaacacaacctccatgaagtgtggagctttaaacctcccataatatgcccccatactagtaggggtacaataagtagtttcaccgctcagaggcaggcagaatttaacaccaacaccttttatacctgtttcatacaccgtgggcagtgtcgaaggcgtcaatgaagtagtggtggtaatattgacataggtcatgcgtccatcattgcatttcatgtccccagacttccagagctccactcgatgcttagcaagctcctgtccaatggaagcagccttaaggattgttttagagggaagagcaatatcctttatgagcggcgatggagtgtttacccaattgcactctattgcagatacctcccgagcaaacagactggataaaaacatcaaggtaagtattagtttgcgcatatatagccccccatttagtgcgccggtacaagtcgatgatgaccagcgagaagtagcaagaaccctctcgccaccataaaagacgccaggcctcaaccagagatagcgccgtcatatttgaggattccgccagaatcgccgatgacctcaaattcaaccttgaggttttcggcctggacgccgtttggcagctccgcaatctcgacctgagaagtcgtggccggcgcgatcatatcgatcggcgcggtgaaactcttgtttcccatccgcagcgtgatcgcggcaaaagacaggtggaaagccgacgggttggtcacttccagatagggcttgccgtctttggcaagcaggcgccacttcagctgttgcggggcctccgtgacctttccgggtaacccggccggccggtagaacagcttgaggcgctgctgcacggcgatttgcagggtattttcctcccgggacttttgcggaacctcccgcacgttcagccagtacacagactccttgtcggtcggcaggcctttgccgctgtacaggatgcgcaacacctgctgctgttcgccagccaggcgcttgagcaccggggtgatggcgaaaggcacatcctcgcttttgtcggccgactcgacccaggcctggaacatcaggtcctcggtcgcgctgttcttgatcaccagggacgcttccttgctcggtgccgcaagcaccacacgggtattttccaggttgatgccggcctgggagaaagcagaaaaaagcagggtgaaactggccagaatcaatccggcgatggctggagtcttcacggtaaattctttacctgcgtatgtgtcgaaggacagccccccgttgttgcgcgccatgtaaaaaatcgatgactcgacgaggcgaaccgtgcgggcattcgtgacgttcgagaaagtcaagaggcaggaaaactacagtagataggcgtcgcaagcagtaggacaattcctaaaaggaacaacgtgctcactcatctgcgaaagcagaaaagagcgaacagaagaaacaatcgccctcagagtccatatcgctagatatctgcctgcgtatcagtgctttctaaaaacaagtcttttcgttccagaagctccaggctgaggatatttccattaccccctgatattcgaaatgtcatgccgtcatagacctgatatttctcgacatgcatgaagtatcaaccctgtctgtttacatcctggttttaacttagaaacccctctcacaggacaaaagcaccgcagtccgaaccgcccatgctcgacgatcgagaaggcctgccaggcaggcttaaagcgctggcccgctgattttgagatgcctcccaaagcggagaaatcggcggtttccccagggaatcgcgcctctgattctgccacgccatcgggcatcaggctgcaaggacttcaatatgacgagcgcagtagcttgccgtcttacttcaactaggaaagcgccgtataccagttaagaaagttctggtttttaattttatttccttttgttaattaatacacccctctgagaaaccaggcatttacatgcaaataactccagccctcaacgctggcgcgtacaggctcgcaatcaactctcccgcgaaatcagatagtcattcgaaacagtcgaatagccatttttagacgttatgtaacaagtctcatctgacaaaaaagctcatgagtctccctcgcttcgaaacccatgaaatcaagcgcggagacaaacaacttgccctcccgactggagggaatggcgctgcggctttgcgtgatcgcctcggcgcccgccccgcatccgttttacccgttctgctggggggatcagcagagtattcatatagaggaagcatcatgaacaaaagctatgcactgatctggaaccaggccactggttgctggaacgtcgccagcgaaggaacccgacgccggggtaaatccagccgcctcaaggtcgtgatcgccgccggcttctcgctgctgggtctgctggcccaggctccggccttcgccctgccgggtggcgcggcggtagtcgcgggcgacgccagcatccataccacctccgacggcaaacacatgagcgtcgaccaacagagcaacaagctgatcaccaactggaacgagttcagcgtcgctggcgacgaaagcgtcagcttccaccaacccggcagtagctcgatcgccctcaaccgggtattgggcaccaatggcagcgatatccagggccgcatcgatgccaacggtaaggtgttcctgatcaaccccaatggcgtggtcttcggcaagtccgcccaggtcaacgtcggcggcctggtggcttccacccagaacatcagcgacaaggacttcctcgacggcacctaccgctttgccgggaattccagctctgccgtgagcaacgccggccagatcaccgccagcgagggcggtagcgtcgcgttgctaggggcccaggtcagcaacagcggcgtgatccaggcgcagatgggcagcgtcgcgctgggcgcgggcaaggacttcagcgtcaacttcgacggcaacggcctgctcaacctgcaggtgaacggtgccgcggtagatgccctggtacagaacggtggcctgctcaaggccgatggcggccaggtgttgatgaccgccagcagcgccagcagcctgctgaacaatgtggtgagcaaccagggcgtaatcgaggccaagaccttgcagaacaaggccggcaagattgtcctggacggtggcgacaatggcatcgtccaggtagccggccgccaggacgccagcgcccttggcggccagggcaacggtggcgtggtggaaaaccgcggcgcccaggtcgaagtgcaactggctgcgcaagtggatacgcacgccgacaagggcacgaccggtacctggaagatcagcgcggccgaggtgagcgtttccaaggcagagaatccgtccacgcgtggattggtcattgacggcggtatcaacggtaacaatggaacgggcggcaataccgacactgccccgacgctgcacgccgataccctggcccagaacctggcgcggaccaacgttgaactgagcagcaagggcaacctgtcggtcaacaaggcagtgtcctggaacagcggcaacaagctgggcctgaccgccgaacgcggcgacgtccaggtgaatgcggcattgagcgccaccggtgccggcgcagccctggccttgaatgccgcacagggcggcatccgtctgaatgacaatgtcgctctaaccggaacgggggcgagcctggagctgaattccaaaaacggccacagcctcaaggatgacaagagcgtcaccctctccggtgcggatacccgcttcagcgccaacggcgagtcctaccaggtggtacagaacctgaagcagttgcgcgatatcgaaaacaacatgaatggccgctatgtactgggtaaccagatcgccggccaaggcagcttcaaaacgcttggcgaaggccgctccttcaccggcaagctcgatggcctgggcaataccatcagcgacctgtcgatctatggcagcaccgcctttgtcgggctgttcggcgcgaacctggggcagatcagcaacctgaacctcgaacgcatttcagccagcggcgcctcttccacctactacaatacccaggtcggcaccctggccggggtgaacatgggtagcatccgcaacgtcaaggccaaggacgtgcgggtgaccggagcctctcacctcaactcgctgggcggcctggtcgcgctcaacctggctggcgacatcaccaactcctcggccagcggccaggtgatcggcaaccagtacacctttgcaatgggtggcttggtgggggaaaacatcaccaaccccgatggcgtggcgaaaatcaccaatagtcatgccgatatcgccctcagggggcagatgaatgctggctccaaaggcgcaggtggattggtgggttcgaaccgcggagtcatcgacaacgcctccagcactggcacgatcgacctcgccggcgccaacctgaacatcggcggcctggtcggtgagaatacgggcgatggcagcatcagcaattcccgctccagcaccaatgtctcgggtagccgggctggtcgggtcggcggcctggttggttccaaccagggttcgctggccaactctcatgccagcggcgacgtaaccggcaatggcacggaagcgatcggcggcctggtgggcaagaacctgggtggttcgattgccaacagttctgccagcaacaacgtgtccgaccgatacagtagcaatgtaggcggcctggttggtcacaaccagggcggccgcatcgataacgcttcggcctccggcacggtgaaaggcggtaggaatgccaatataggcggcctgatcggcacgaaccaggacggcttgatcagcaacagctcggccaaaggcaatgtgtccggtctgtacggtagcaatgtgggcggcctgattggctacaaccggagcagtcatatcgataatgtaacggtcgccggcacggtgaaaggcgatagcaaggcaaatatcggcgggctgatcggctacagcgaaaagtcctccatcgctaatgcctcctccacctcccagtctgttacaggcggcgatgatgcccgtatcggcggtctcgtcggccatagccagaatgacaatatcgccaactcatcggtatccaccaccgtgaccggctaccaccgcagccggatcggcggcctggtcggctacagccagaataccgatatcaccgacacctcggcatccgccatggtggagggcctcgacaatagccaggtcggcggtctggtcggtcacggccaggacagccgtatcaacaattcctcgacattggtcacggtgaacggcgatgccaatagccaggtcggcggcctggtcggctatagccaaggtagcgatatcaacaatgccacggtatccgccacggtgagtggtggtacaaccagcctggtcggcggcctggttggcaggcagcagggcaagatcggcaacgcctccgtcaaaggctcggtcaaaggcggcactcaaagcagcgtgggaggtctggccgggcagaatgaaggagagatcagcaactccagaactaccagcaacgtcagcggcggttatggcgcacgcttgggcgggcttgtgggggtgaacttcggtaaggtgcacctgtcctcggcaggcggcaagatcgatggttctcacgccttcggacagttctacggtggcctggtcggcatcgacttcaattcgaaccagccctccaacaacagcgtctttggtgaagcgaccaaggtgccgcaggttggcctgcagttctgagaactgaagctctgccccccgtcatagggaggctgggcttgttgtctgattgaaaagagggggcaatgattcagccgaatcattgccccctctttttgtccggcgcctctcggcgccttgctccagagctctacttctctgtcgcgacctcagtaccgtcggcgcccggaacgctggaccgggtcaggcggtagatggatgcgcagtagagcagcagcgccaaggtcgccagcaagcctccagccaagccgatataggcgaacccgagttggctccctacccagctgccaagcagcgcgccgccgccgatgccgatattgtagatccccgaaaacagcgccattgccacatcggtagcgtccggagcgagcaccaggaccctggactgcagcgccagcccgaagcccatgatcgccatcccccagatcaggctgagcccgcccaggtacgagacctccccgctcaacggcaacagcaatgccaggcacagaatgagcgacgccaccgtcaccagcagaaagcgctgcgggctgtagcggtgaaacctgctgaacaacagcgagccgaagataccggcgccgccgaacagcagtaggatgagggtcaccacatcgccactcaagccggccaccaccttgatgaaaggctcgatatagctataagccgtgaactgcgcggtgaccaccagggccgtcagtacatagagcgccatcagcgctggccgcttgaacagtaccggcaggcttctgagagaacccgagttctggctgggcaacaacggcaggctcctggccagccagaacaccagcgcggtagccaggccagcaatcacgataaaggtggtccgccagcccatggcctcgcccagcaacctgccgaggggaatacccagcaccatcgccaaggaagtaccggtggccagcaagcccagggcctggacctgttttcccggtggtgccagacgcaccgccagggacgcggtaatggaccagaacagcgcatgggacaaggccacaccgacccggctcagcaacagcatgccgaaactcgtggccagccccgacaggatatgactggcaataaacatcccgaacagcacgagcaacagcttgcgccgctcgacgttgcgcgtcagcagcatgaccggcagcgaagtcagggacactatccaggcataaagagtgagcatcagaccgacccgggccgtcgacaggtcgaagctgctgccgatcgagctcaatagcccgacggggacgaactccgtggtgttgaacacaaaggccgccaacgccagtgcgatgaccgcccgccaattacccttagttgtcgccacgcagatactcatttaaaggtgcaccactctatcgatggtcaatcaggcccagaccttcgcaaaccctgtgccaaacgcctattcacaaaggctgggcgcacggtcaggagcatgcaggcgccgaacaggatctgcgtcagcgtacaggacaagaggaaagcagcgtcatccggcactacagaggagcaatggaccgaagctcggccactgccgacggaaacgaaaaaagggtcccgaatgggaccctttttcgatgaactacagacctttgaaaatctgtagctccatgtttggagcgggaaacgagactcgaactcgcgaccccgaccttggcaaggtcgtgctctaccaactgagctattcccgcaaatggcgtcccctaggggactcgaacccctgttaccgccgtgaaagggcggtgtcctaggccactagacgaaggggacacgctacccggaacacatggtgtgtgtttcggtgtccagatccgcatccgaagacttggttctggtttcactcagccccgcccgaaagcagtgccgtttaaaattggagcgggaaacgagactcgaactcgcgaccccgaccttggcaaggtcgtgctctaccaactgagctattcccgcattggcgtcccctaggggactcgaacccctgttaccgccgtgaaagggcggtgtcctaggccactagacgaaggggacacgctacaacattcactccctgccgcgtttcgctgtgtgctttacgctgcaagtggcgcgcattctatggatggattggagggtcgtcaaccccctgatataaatttatttaaatcaatgacttcggggtggtttgcgagccctttcgggcatttgtgcagcctgtgccttgacgcctatattctgacactcgacaagacgctatagtccacatccttaggtgatggcaatatgaaaccagccagacatttcctatataagcagagaatcggcctgtttctgctcgtcgacctgcgctaggcgccccaaggctaagtcactacactcgccactcgtacgcgaaccccagaaagaggtcttacacggtgacaccactcatgatcaccctgctagtagtagccgggatcgtaatattgatcgccattggctacatgaaccatgtggtggaaaacaacaaactggaaaaggcccgtaccaaggtcgaactcaatgaccgcctgcgccgctgcggcgaaatcaccgagaccttccccggccagttcatgtcgccagggctcaagctgctgatgacccgcctggagctcaacgtcgttcagcgtctgttgaacctgaacaagtccgatgccgcgctcaaggcgcgtatcgccgagttgaacgcgctggtcggccagggcgaatcgattccggtcaacaacccgccctgcccgatccagaccgaagccaaggccaaggacgtgcgctttctcttggaagccctgcatggccaggtgacgcgcgccgcccaggacggtttcctgccgaccaacgaagccaagcactggatcagggaaatccgccatatcctggtgctgctgcatatcgagttcttcaacaacctcggccagtacgccctgcagcaggaacaacccggccaggcacgcctggcgttcgagcgcggtgtgcagtacctgcgcaagcagccggatccggcggtctatcgggaacagctggagtacctggaaaaactcctggcccgctccaacgcgatggtgctgaccaatacccagccggtcgaaggcgaggtcaaccaattgaccgaaggcctgaaggtcgtcgaagccgacgccgactggaagaagaaagccatttacgactgaccggcaacagccgcgcgagccattcgcgcggcacggtctataaggctgcacccctggcggcgcagcctgtagcaagcacccgcggcattacaaccggaaatgcccgaccatccccttcaactccgcccccaactgcgccagctcgatgctcgacgctgcattgccctgcatggccagtgacgactgatcggcgctggcgcggatgctggtgacgctgcggttgatctcttcggcgaccgagctttgttgttcggcggccgcggcgatctgctggttcatctgctgaatcagcgacaccgccgtggcgatgctgcccagcgcgctttcggtctgcagcgcatcgctgaccgccagcttgaccagttcgccgctgctctggatctgctgcaccgaggactgcgccgccgaacgcaaggcactgaccaggcgttcgatctcttcggtggattgctgggtgcgcttggccagggcccgcacttcgtcggccaccaccgcgaagcccctgccctgctcgccggcacgcgccgcttcgatggccgcgttcagcgccagcaggttggtctgctcggcgacactcttgatcacgctgagcacggtgccgatgttctggatctcggcgctgaggctttcaatgctggagctggcgctggtagccgaatccgccagctgttcgatgcgctgcatactctggcgcaccacctgctggccactttcgaccttgtcgtcggcggtctgcgccgcctgcgcggcttcttcggcgttgcgcgcgacgtcgtgcacggtggcggtcatctggttcatcgccgtggccacctgctcggtttcttccttctggctgctgacttccagattggtctgttcggtcaccgccgacagcgactgggccgagctggccaactgttcgatgcctgcctgcaggccgctgacaataccgctcaggccgctgcccatctgttgcatcgccagcatcaactggccgatttcgtcccggcgcgtcacctccaccgtcgcgctcaggtcaccggcggcgatctgctgcgccacacgcatcacgctgcgcagcggagtgacgatcaagcgggtaatgatccaggccgccaacacacccaccagcaacgccagggccgaagacgcgacgatcagcaacgaattctttttcagctccgcctgcatcgactgatcctgcgcgccgtacgcctggtcgacccgctccatcacttgcgcggcgcgctcgtgcagctgctgatagacctttttctcctgcgccagcaagccggtgtattcggcgagcttctcgctgaagccaccgatatgcccgaccacttcgttgagcaccgtctgataaccggcgtccttgaccagggtcttgagctgctcggcctgggcctgggcctgatcggcctgctcgatcttgccctgctcgacctcttcctcgcccttgcggctctggtccaggcgcacccgggcttcgttcatggcttgcagcatcaggcgcgagacctggctgacctgattggcctgctcgacgaactcgctgccctccttgccggcagactccttgaggctataggtaccgtcatcggccaggccggcctgcagcacgtcgaggttattggccacgctggacaccgaccagctggccatttccagcgccaggtccttggcctgggtcagctcgacgaactcgtcgaaagccttgcggtaagcccccagcgcctgctcgacatcggtcatcaccggtacattcgccgccgaacgttccttgagctgcgctgccagggccagcaaggcgtcgacgccctcgtgcaaggcgtccgcggttttagcgtcgccgtgcaaggcatagttctgttcgagcagacgcaccttgagcaagccgctgttgagcgacgacatctgcttgaggccatcgaaacgctggctgatggtctgcagggaccagacgccgatggcggccaccagtgccgtcagcagcagcaccagggtgaaaccgacacccagttttttcgccatgccgagattggcaaaacgtccgttcgtggccgaattcattgcgctcagtccccttccagtccccaatggcaacagggccattgtccagttttgcaggttcgcaacgggctgcactggagcacaagtctctggcgtcggaataatggcaaaaagctacgttcaggtcgttttcagaatggtcgaggtcgatccggtacagccctggcaacgcttggtcaccagggccgtccctaaggcaggcgagcgtcagatggcggtggcgccaccgtcgaccgccagcgcatggccagtggtgaaggccgcgccgtcgctgcacagatacagcaccgcgctggcgatttcctcgaccttgccgatccgcccgaccgggtgcatggccgcggcgaattcggctttcttcggatcagcctcgtaggcacggcgaaacatatcggtgtcgatgaccgccgggcacaccgcgttaacccggattttcttcttcgcatactcgatggccgccgacttggtcaggccgatcaccgcatgcttggaggcggcatagatactcatcttcggcgccgcgcccagaccggccaccgatgcggtgttgacgatggccccgccgccctgggcgagcatcagcggcaactggtgtttcatgcacagccagacgcccttgacgttgactcccatgatcgcgtcgaactcatccagggtgccgtccgccagcttgcccttctcgatttcgatcccggcattgttgaaggcatagtcgaggcggccatagctgcttaccacctgggccatcaggttctgcacatccgcctcatcggtaacgtcgcagcgcacgaacagcgcctcgccaccggcggcgcgaatcaattgcaccgtaccctcaccaccggcgacgtcgaggtcggccgccaccactttcagtccctgcgcggcgaacgccagggccgtggcccggccaatacccgccgctgcgccggtgaccaaaacgacctggccggaaaacgtcatgctcatggtgatgccctcgatggaatgcatggatcggattcgcccagtctaggcacaggcaacgggcacgcggcagcactatcagagggccggttgcccacttatccgcggtggtgatgaaagccgccatacgaccatcacgcctctggatcgccccctattcgctacagcggcaaaccttgcggcatcagggctgaaggtctatcaactagggttccatcgatccttgagtgcctgccatgaccacccaaaccaatcgccagtttctgctcgccaaacgcccggtgggcgcggcgacccgcgaaaccttcacctaccagcaggttcccgtcggcgaacccgcggcggggcagatcctggtgaagaatgagtacctgtccctcgacccggccatgcgcggctggatgaacgaaggcaagtcctacatcccaccggtgggcatcggtgaagtgatgcgcgccctgggcgtgggccaggtgatcgcctcgaacaatcccggcttcgccgtcggcgactacgtcaatggcgccctgggcgtgcaggactatttcctcggcgagccgcgcggcttctataaggtcgatccgaaactggcgccgctgccgcgctacctgtcggccctgggcatgaccggcatgaccgcctatttcgccctgctggacgtcggtgcgccgaaagccggtgaaaccgtggtgctgtcgggcgcggccggcgcggtgggcagcattgccgggcagatcgccaagatcaaaggctgccgggtgatcggcatcgccggcggccaggacaaatgcaagttcctgatcgacgaactgggcttcgacggagccatcgactacaagagcgaagacgtccatgccggcctcaagcgcgaatgcccgaaaggcgtcgatgtgtatttcgacaacgtcggcggcgacattctcgatgccgtgctcagccgcctgaacttcaaagcccgggtggtgatctgcggcgccatcagccagtacaacaacaaggaggcggtcaagggcccggccaactacctgtcgttactggtcaatcgcgcgcgcatggaaggttttgtggtgatggactatgcggcccagttcgccgccgccgggcaggaaatggccggctggatggccaaggggcagctcaagagcaaggaggatatcgtcgaggggctggagactttcccggaaacgctgatgaagctgttcagcggcgagaacttcggcaagctggtgctgaaggtttgaacatggctctttgaatcgggttgtctgtccgatcgtttcgcgagcaagctcgctcctacaagggcctatgcactctctgtaggagcgagcttgctcgcgatagcgcgaagcgcgcttgcactatcgccgacagccagcactgcactgccggattcaggccagctcggccaccacggccgccagggccttggccgggtccgccgcctggctgatcggacggccgatcaccagatagtcggaaccggcatccagcgcctgacgcggggtgaggatgcgccgctggtcgtcctgggcgctgcccgccggacggatccccggggtcaccagttgcagcgacgggtgcgcggccttcagcgcctgggcttccagggccgaacagaccaggccgtccatgccggccttttccgccagggcggccaggcgcagcacctgctcctgcggctcgatatccaggccgatgccggccaggtcttcacgctccatgctggtcagcacggtcacgccgatcagcagcggtttcgggccgctgcgctggtcgagcacttcgcggcaggccgccatcatgcgcaagccgccggagcagtgcacattgaccatccacacgcccatctccgcggcagccttgacggccatcgcggtggtgttggggatgtcatggaatttcaggtcgaggaagacttcaaaacccttgtcgcgcagggtgccgacgatttccgaagcgcaactggtgaacagttccttgccgactttgacccggcacagcttggggtccagctgatcagccagtttcagtgcggcgtcacgggtgggaaagtccagggcgacgatgataggagtctggcaagcggacatgaaggggctctcaggcaagtcgaaatcggcgcggattgtagcgcaagcgacgacgctccgggacccgatgatcggtaattcatcgccaacggcagctcccgtatcgataaaaccgtgcaaatgcccgaccctggcggtaattgtgtcgagcccgatacactcccgacacgccggcaacaccccgcccggctaccctcgccagccgcaacactcccgaacagcacttccagccccagggccggacgcctatgctgaagccaccacctcgccgcccctctttgtggctggcagcctacctggcagacgattgcacgcatgcacaacattccagctcccctcaatgacgatcagaaagcacctggcacgggtgacgacaagcgctggaacacccgggcgctgatcgtcgacgacgatgtaccgatccgcgaactgctgatcgactacctggcccgcttcaatatccacgccaccggcgtgaccgacggcgcggcgatgcgccaggccttgcaggcggaacacttcgacgtggtggtgctcgacctcatgctgcccggcgaggatggcctgtccctgtgccgctggctgcgtaccgagtcggacatcccgatcctgatgctcaccgcccgctgcgaacccaccgaccggatcattggcctggagctgggggccgacgactatatggccaagcccttcgagccccgggaactggtggcgcggatccagaccatcctgcgccgggtccgcgacgaccgcaccgagcagcgggccaatatccgcttcgacaactggcgcctgaacagcgtgctgcgccagctgatctccgcagacggtcttgtcgtaccactgtccaacgccgagttccgcctgctctgggtgttcatcgaacgcccgcgccgggtcctgagccgcgaacagttgctggacgccgcccgtggccgctccatcgaagccttcgatcgcagcatcgacctgctggtctcgcgcctgcggcagaagctcggcgacgacccgaaatcgccgcagttgatcaagaccgtgcgcggcgaaggctacctgttcgacgcccgagacatcggctgatgcgtgggcgcttcgatacgctgttcggccgcctgttcggggtgctgctgatcgcgatcgtgctcgcccacctgctcgccttcttctggtttcgcctctacggcccgcctccacgcccgccggccagcgaattcagcggccagccacagcccggcggcgggcgtttcgagccgcggccaccacgtccctggttcggcggcccgatcgtgccgctgaccttccagttcatctcgctgatcatcgccgcctggtacggcgccaagctgctgacccggccgatccagcgcctgagcgatgccgccgagcgcctcagcgaagacctcgacagcccgccgctggacgagtccggcccacgggaagcacggcaggcggcccacaccttcaacctgatgcagcggcgcatccaggaacaggtcaagcaacgcgggcgcatgcttggcgcagtctcccacgacctgcgcacgccgctgtcgcgcctcaagttgcgcctggaacagatcgaggacaacaagctgcagggccagatgcgccaagacctcgacgacatgatcagcatgctcgacgcgaccctgagctacctgcatgaacagcgcaccagcgaagccgtgcagtggatggatgtgcaggcactggtggagtcgctctgcgaaaacgcccaggaccagggcgccgacgtgcggaccgacggccattgcgcgcccttgcaagtgcagccgatggccctgcgttcctgcctgaacaacctgctggacaacgccctgcgctatgccgggcatgcccgcatcagcctgcaggacagccgcgagcaggtgctgatccgggtcatcgaccatggcccgggcatcgccgaagaccaacgcgaagcagtgttcgaacccttctaccggctggaaggctcgcgcaaccgcaattccggcggcgtcggcctgggcatgaccatcgcccgcgaggccgccgaacgcctgggcgggcaattgcacctggaagaaacccccggtggcggtctgaccacagtggtgcgcctgcctcgcgcctgaaccgccggtgtgtaccggctggtacaaagctcacatacccacgacacctcgccgcctgagcgccgccgtcaccgtaaccgccgtagccgctgccgagcagcgcgaggctgcggctacaggagcgggcacggatgcccgcgttctgcatggatcagcgcttgtcttcgacccgcgcctggctcgcgctccagtcggtcaacaggctgtaggccacggccaacagggtcgggccgatgaacaggccgatgaaaccgaacgcgatcagcccgccgaagaccccgagcagcacgatcaccagcggcaggttgccgccacggctgatcaggtagggtttgagcacgttgtcgaccccactgatgatgaaagtgccccagataccgaggaacaccgccatcccgtattcgcccttccaggccagccaggcggtagccggaatccacaccagcggcggccccatgggaatcaggctgagcaggaaggtgacgatccccagcaccagcgcacccggcacgccggcgatcaggaacccgatcagggccaggactgcctgggccgcggcggtgccgatcacaccgttgaccacccgctgcaccgtaccggccaccagctcgatgtagtagccggcgcggtcgccgatcaggcgctccagcagcccgtggacgaacaccgccaggcgcggcccgtcgcgatagaagaaaaacacgaagacgatgctcagggtcagctcgaggatcccgccaccgatctgcgcgctgcgggccagcagccagttgccgacctgccccaggtagggcttgatcgccagcatcatcgccgcgccctgctggtcgatgctgttccacagccccaccagccgttcaccgacgaagggcacgccggccagccagctcggcgctgcgggcaggccatcgacctgcacatctttgataaaggcggtggcgtcacgcacatggtcggccaggttgaagccgagccagaccagcggcgccgccaccagcagcatccagcccagggtcagcacggccgcggccagggactcgcggccattgagccagcgggtcagcaggcgcatcagcggccagctggcaaacgccaggaccgccccccagaacaacgcggaccagaacggcgccatgacccagaagctggcgccgaacagcaccagaagcaggatctgcaccaacaggcgatcattattgagcatttggtatctcgagaaaggtcaactcaccaagcgtaggcgaacggtggatacccgttcgcccaagcccgttcaatgcagcggttcagcgcagcagctcaagacgcaggccaggggcctcgcggctgccgctttccatgcgtgccgcccgcacgccctggccgatcagggcctggcgccaggcctcggcattcggcccggaaacactgacccgcaaggtggtatcgaggttcaacccgcgcgacagcaaggtcagccaggtaggctggggctcgccggcgagcttgggcaggtccagctcgccggtgtccttgagctggcgcaacagggtggccgaggtcggcaacaactcgcccaggggggtgctggcgtcgaattgctcgacatgcaggtacgcccggcggttgccgcgggtaatgctgtacagggccaccagcgaattgttgttgggcgcggccaggcgcaacagcaggtacgcctgctgggcatcggcgccatacagcttggcgttgccgaacacctcgttggcccacaggctgctttccccgcaatcgcgggcctggcaccagaacaacagttcggcgccctgcccctgcaaggcttcgcgggcggcggtaaaggccgcggtcgaggaatgttccggcggcaactcgtaggtcaccgacgtcgtcgtgccacgagcgccgacctggccatcgaaacgcagttggccgctgatcttgcggatcgagcccatggggtagatccgctccatctcggccgccggacgatagtcgacgatctgcgcgtcaggcatgcgcggcacgatcggcaagtcatggctgccgggcaaatcggcggcgaacagcaaggggctgacagcggacaacagcaggacactggataaacgcatgggtgctctcatcggatcagcatggcctgggcgcccttgatgacactggcgtcatccgtgcgttgcgggaccagcagcccgcgctgcaccgccggccgcgcctcgagggtcgccatccagcgttgcagggccgccaggccgtccaccgaaaccccggaccattcatggccgcgcacccagggaaaggtggcgatatcggcaatgctgtagtcgccggcaaggaactcgacctcctgcaagcgggtgtcgagcacctcgtacaggcgccgggtttcatgctggtaacgatcgatggcgccctggagcttttccggaaaataacggaagaacacgttggcctggccctgcatcggaccgatgccgcccatctggaacatcagccactggatcacccgggaacggccctgaggatcgctgggcagcagttgcccgctgagttcagccaggtagatgagaatcgcgccggactcgaacacggcgaaattgccgttggcgcggtcgacaatcgccggaatccggccattgggattgatcttgagaaagcctggagccttttgttccttcttgtcgaaactcagggcatgcaccgtatagggcaggccgagttcctcgagcacgatagagaccttgtggccattcggggtcgcagcggtatagagatctatcatggttgtctcccatttcaacccgcccagcctcgacagttgcccgctgcaagtcaagaaacggcgaaaaacctattgaaacagtctgcaacaaggatcgcgccgtcttcgtcgttcaagtgcaggtgatggccaccgggcagctgttcccggctgaagggtagccgctccagcaactccgggtgcttggccagcatgccgtcggccgccaccaccagatgggccggacaggccaggcgctggacgaacgtcagggcctgctcctgggtcaggcgcagcggcgacgccagggtcaggcggctgtcgctgcgccaggtgtaaccccccgggaccggcatcaggccacgttgcgcgagcagttcggcggcttcgcggctgaccgcgaccatgcccttcatccgcgcctcgatggcgcggtccagggtggcgtagaccggcttgcgcttgtcccgcaggtccagctgagcctgcagggccatgcccatgcgctcggcagcgttttccccgctggcggtcggcggaatcaccccatcgatcagcgccaggtggctcacccgctcgggcaacgagccggccagcaccaacgagacaatcgcccccagggaatgcccgagcaggccaaagcgtttccagcccagctgctcggcgacctgcaaaacgtcatatacgtaatcccagagcgcatagctggcgcccagggggcggtgtccggaatggccatgcccggccatgtccagggcgacgatgcgcaagccaggcaatctgggcgccagccgcgcgaagctgttggcgttgtccagccagccgtgcagggcaatgaccggcaaaccgtcctcggggccgaacaggtgcgccgccagctcgatatgcggcaggctcaggcggacttcttccaccgcggcgctcatgcgcagctccgttcggcgcgagcttcccagcggctgaagagttttttcagcagggccgcggtgtcctgcgggcgctccagcgggaacatgtgcccgcccggcatgctcagggattcgccatggggcatgcgcccgacactgctggcgtggtgcttcatcaccacccggctctgccgcccgcgcaccaccgccagcggcaccttcaactgccgggggcggcccgggctggtgtgcggcacgccgcgatagatgctgatctcggtgccgggtcgaaacgcagccgcaaacggccgtcgacctgatgcaggccatgttgcaggtaggcgtcgaaacactcggggtcgaagccgcggaacagggtcttgccggcaaaatacttgcgcgccgactccaggtcgctgaactcctcgcgccggcccagggtccgcccggcgggggtcaggcgatcgatgaaaccgaaccgcttggcggcgcgaatcacccattgatcggcgcgggtcagcaccggcgagtcgagcatcaccaccccgcgatacagctccgggcagcgcagcgccgcatgcagatgcaggacgccgccgaaggaatggccgacaccccacaccggctcggcctgctgttgcagatggtggatcagttcgtccaccaggttcagccagttgtcgtccgccggaaagcgcggatcgtgggcgtgctgctgcaaatgcgccacttgatattcgggggccagggcggcgaacaacttgccataggtacccgagggaaatccgttggcgtgagtgaaaaacacctgttgcgacataccggctaactcatgaacaaaaaacgatggctgattgtccgcatgccattagccggcggcaatgacagtaacggtcaagaatgatgacactccgcttcagcctatgggtacccctcaacgtgccggcggcgtctgccccagcggcactacggccatggtcaggcgcgatacgcagctggccttgccttcgtcgctgcagaggcggatatcccagacatgggtggtacgcccgatatgaatcgccctggccaccgccgtcacccggccggaacgcaggccgcgcagatggttggcgttgatctccaggcccacgcagtagaacttgctggcgtcgatgcacaggtaactggccatggagccgaccgtttccgccagcaccaccgaggcaccgccatgcagcaggccatagggttggtgggtgcgatggtcgatcaccatgctcgcggtcagggattcgtcgtcgaaggactcgaagcggatgtccagcacctcaccgatggtgtttttctggatcgcgttcagttgctcgatgttcggggtggtacgccataggctcatcactgcatccttttgggtggttatccgcgctcaatcctgccacagcaccgcttcggagcgctcgctccactctttgaagcgctcgccgtaggtggcttcgatgacattgcgcttgatcttcagggtcggggtcagaaagccgttctccaccgcccaactgtccttcaccaccaccaggcggtgcaagcgttcatgtttgtcgagcgcgccattgacctcgtcaagcaggctttccaggctcgcatgcaggccaccacgggagttgcctgcggcgtcctgcaaaccggccgcggacaacacgcacaagcccagcggcgcgctcaggccatcgccgaccacacacacctgctcgatccgcgaatgcaccgccaggcggttctcgatcggcgccggggccacgtacttgcccttgctggtcttgaagatctccttgagtcgcccggtcaggcgcagattgccgtcggcgtcctgctcgcccttgtcgccggtacgcaggaaaccatccgcggtgacggtttccgcggtcttctgcgagtccttgaaatagccgagcatggtcgccccgctgcgcacctggacctctccggactcgtcgatccgtacctcgacgtccgggcagggccggccgatccagccgggtacatgctggccgctgcggccgatatgggaataaccgcaactttcggtcatgccgtacacctccagcacgtcgaggcccaggcgctggtaccagtccagcagggtctgcggcaccggcgcggcgccggacaaggcgacccgcagcgcatccagccccagcccggccagcaccttgtgcccgacccgcttgccgatgaaaggcaggcccaacaggaagtccaggcgcttggccgggaccttgctgtacacgcccatctggaacttggtccagatccgcggcacgccgaacaacgccgtgggccgcgcccgctgcaggtcggtgagaaaggtctccaggctctcggcgaagaacaccgtttgcccggtatagatcgccgccagctcgacgaacatgcgctcggccacatggcacagcggcaggtaggacagcagccggtccgtcggcccgaggccgaacagctgggtgccgcgtgaagcggcgaaacccagggtgccgaagctgtgcatcacgcccttgggcaggccggtggtgcccgaggtgtagatgatggtcgccagttgctcggcggcagggttggggtcgtcctggatcggcgagcactgctgcaactcgtcccaggtgaagtcgaagcagccttcggggcagataggcaggctgatggtgggcagcccgggcttcacgccgggggccatcgccggccagtcgtcgagcttgccgatgaacaccagggccgactcggaatgttccagcacctgggccaccgaatcggcggtcaggttgggatacaggggcacggaaacgtgaccggccatccagatcgccaggtcggcgataatccagtgggcgcagttcttggaaatgatcgcgacatgactgcccggcggcagctcgcgggcacgcagccagtgggcggcgcagcgggcctggtggccgacgtcggcccaggtcagctcctcgacccggccgccgcccaggggctggaccaggaaacgttggcggggatgacgagcttcgcgctcgtagaacacttccagcggcaaacgaaaagcagcagacatgcgactcgctcctttgtttttgttctgatcgtgaggctagccaaccaagcacttgctcgggcgactattccacgcacaaagaaacgccgcaagttaagaaatgtagcgaaaagcacagatcgtggtaggagcgaggcttgcccgcgataagaggaacgcgctgcttcagacagtccgcgccgcttccttcgcgggcaagcctcgctcctacagctcaggggctcagggattcttgatgctgttgagggtcatcaggccggccagcggccagtcgccttcaagttccgccaggcccgcggtgtgcatcggctggggattgcgcagatggccgtgctgcaggaggccgatcaggttgcccaccagcggctggtggctgaccagcagcacgttgtccgccgagtcgagctgggcgaccaccgacagtgggttattgtccggcgtcagccaggacacagtgcggatgtccgcttcgaagcccagggcttcgcgcaccagcttcgccgtctgctgcgcccgcgcataagggctggcgatgatcgcgctgagcggctggccgatcagatgcgcggcgctgcgcagcgcttcctcgcggccatgctcggtcaggttgcgctcggcatcgctgcgcgcatgcggctcggcttcaccgtgacgcagcacccagagcttcacagcttgggctcctcgtcccgcaccggatggggcgccggtggcaccacatgcggcgcttcgccttcaggcgcgcgcggggccggccagtcggcgaacggccaaggcttctggtcggtgtggaaactgccgaaacgaccgatctgcgccaggaactggctcaggctgtcgccgaagttcatcaggctggcacttggcgagccgtagatcagccggtagatcaactgcaccagcaccagcgcgccgaggatgaattgcgccacttgccagaccagcacgaacaccagcatccacagcacacgcagcaggatggattcgtacttggcttcggaattcgtatcgttcatgtctcgctcctgtcctgctcagttgaaaccactgggggagataaagtcgacatcggttttcggctcgccgcgcatcagcagttcgatgacctgattcagcgtgcgcccctcaaacaggatggcatgtaatccggccaccagcggcatatatacacccacttcctgtgccttgaccttgagcaccttgagggtgttcacgccttcggccacctcgccgagccggtccaccgcctcttccaggctcaggccttcgcccagggcgaaaccgacctgatggttgcggctcttgggcgacgagcaggtgacgatcaggtcaccaacccccgccaggccgaggaaggtcatcgggttggcaccctggctgacggcaaaacgggtcatttccgccagcgcccgggtaatcagcatgctcttggtgttttcccccatgcccaaggccacggccatgccggcgatgatcgcgtagacgttcttcaacgctccgcccagctcgacgccgaagcggtcggcgctggcatagacgcggaaggtccggccatgcagggccgcctgcacgcgctggcagagttcttcgtcttcgctggcgaccacggtggcggtcaaggcgtgttcggccacttcgcgggccaggttcggcccggacagcacgccgatccgcgcttgcggggcgatctcttcgaggatttcactcatcagcttgaaggtctgcgcctcgatgcccttggtcaggctgaccagcagcttgccggcgagcaactgcgcatggggcgccagcaccgagcgcagggcgctggagggcaaggcgacaaaacacaggtcactgtcgttcagggtggccaacagatcggtcaccggctccaccgccggatgaatcttgatgcctttgaggtaacgcggattttcgcgatgaatgcgaatggcctccgcctgctccgggtcacgcatccactgccgcacccgatgaccgttctcggccagcagattggccacggcggtaccaaagcttccgcctcccaggaccgcgatagggcgctgttcagtcatatgcaatccgtcaatccatacagtggcgatggcggcattatacggggcggccctgcggcggccagccctgtgaacaattaggcacaaatgccgggaaaacaccgattaggacggggaatgtcggggttatcgactggaaaacccggtcatctcggttaacatgcgcggcaattactcgttatcaaggctgtgccgtgtatcctggccctcccctctcccgcccatccctgttgctggcgctgctttgcagcaccccggtgctggccgacgatctgttcctggacagccagccgctgccggaaatcctcaccgccacccgtctgaaacagtcccccgcggccgtgcccggcagcatgaccgtgctcgatagcgaactgatcaacgccagcggcgcccgcgatatcagcgagctgctgcgcctggtgccggggatgatggtcggcaatatcagcggcaaccaggccgcggtgaactatcacggcaccaatgccagcgaagcgcgccgcatgcaggtgctgatcgatgggcgctcggtgtaccgggcgggcctggccaccgtggactggagcgacattccggtggccatggaggacatcgagcgcatcgaggtgttccgcggccccaataccgtcagttacggcgccaacgcgctgatggcagtgatcaacatcatcacccgctcgcccgccaacagccacggcacgcggatcaaggtcacccgcggccagcgcggcatcagcgactggtacgccagccagggcaccggctgggacaccggcgacctgcgcctgtcgctgtccgggcaggaggacgacggcttcgacagcgatcgcaacggcgccgactatcgcgacagccgacgcttgaaccgcttcagcctgtcggtcagccagatgcttgacgagcggcagagcatcgactggcaactcagcgccaaggaaggcagcaaccagcgcccctatacctaccggccggtgttctccggcatcacttcggccggctacaactccgacgtgatcgccaaggactatgccggctcgctgcgctggaacctcgacatcaacccggaccacagcctttatatacaaggctcggcccagcactgggaccgccagcagaactggcgcgcctgtgacgccgaggtgtcgttcagcccggaactgacccgcctctggcagctcaacccgaactacgccgaactgctggcccggcacatggacaatttcaccggctccggcgcccctccaggcaccgcggccgaacaggccctggcgaaccaggtgctgacgcaatggaagaacggcgccaagcgcacggtctgcggggatatcgaccagagcgcccgcgaatcgcgctacgacctcgaactgcaggacaccctgagcctgtccgatggcgtgcgcctggtcagcggcctgaactatcgctacgaccgcgccgactcgcaaacctatttcaacggcaccctcgatgacagcacctggcgcgccttcggccagctggaatggcgcgccaccgaacactggctgttgcagggcggcgccatgttcgaggactcacagctgagcggcagctcgctgaccccgcgggtggcggtcaactacctgatcaacccgcgccacggcctgcgggcggtatattcggaagcgatccgctcgccggacatgttcgagaacaacgtcaactggagctaccgggtcaccaagctgagcccgaccgcctacggccagcccagcgcccagtacttcgtcaagacccgcggcccgggcaacctcgaccaggaacgcatgcgctcgcgggaactgggctacaacggcttttttgccgatctcgggctgaacctcgacgtgaagctgttctacgacgaaatcagcgggatgatcagcgagccgctgcgcaacaaccagtacatcgccagcaacagcaacgcctcacgttttgccggcagcgaaacccagctggactggcgcctgaacccggcggaccggctgcgcctgacgtacgcctatgtcgacgccgaggccagcaacccgctggacgagcaattgaccgcgcgccacagcggctcggcgggctggttgcgcgactgggaccagggctggtccagcgcgctcttctactatggttccagcgcgctcaacggttatcgcttcgaacgggtcgatacccgtgtcgccaagcgtatccccctgggcaagggcagcctggagctggccggcgtgctccagcaacggctcgacgacgagcccaccacctttgtcgacaacaactatgactcgcaccacgtcctctacttcagtgcggagttgacgttctagcatgagccaccgtcagtcagggatgacgcctgccttgaaccgtttccgggttcgcctgctgctgttctgttgcctctggggtgcattccccgcatgggcggcccaggtgttgctgaccggcgccgaagacagcgccggcgtgcaggcttttgcccaggcgctggcgcaacagcggccacaggacgacgtgcgcttcgagctcctggccaacctgcctgcccccggtcaattgccagcgggcacccggctgatcctgctcgacccggccagcctcgaatggcgccagcaggaggccctgggcccggccacgctggtgttgcgcatcggccggatccaggctcagcagcgcctggggacaacgtcttcgccccggttgagcctgttatggagcgacccgccgctggctcggcaattgctgctgatccgcaagatcctgccccaggcccggcggatcggcgtgctctacggcgccgacagcgaattcctgctcaaggagctgcatcaggccgcccatcccctggggctggaaatcgtcgccgagcgctgggacgacaccaatgacagccgtccgctgcaaagcctgctgaaaagcagcgacgtcctgctggggctggacgatccgcagctgtacaacccgaaaaccgcgaagaacctgttattgagcagctatgcccggcaactggcgctgatcggccccaatgccggcttcgtcaaggccggcagcctggccagcacctacagcgaccaggacgactggctgcaggtgctcgacgatttgctggaccggcccactacccactggccgcgtaccctgtatccgcaaccgttcaaggtgttgagcaacccgcaggtggcacgctccctgggcgtcgaaccgatagacgagcaatcggtggcgacccagctggccgaaggagaaaaacgcccatgaccttccgtcgccgttgggacatcagtacccgcacccagatcatctgcctcggcccggcgctgctgctgaccctgctgctgatcagcttctttaccttcgtgcggatccaggatctgcgccaggagttgaaccacaccggccagttgatcgccaaccagctggcgccggccaccgaatacggggtgatctcgggcaacagcgaaggtctcgagagcctgctcaaggccaccctggccacgccccacgtgcgctttctcgaagtccaggacagccgcaacaagatcctggtgtacgtcgagcagccttcggagacccaccaccgctcacagcaggtcgaagtgttccaggccccggtgcgcctgcaacgcatccagctcagcaacgattttttccaggacgacccgagcgccagcgtgagccccagcgaggactacctggggcgggtgatcgtcggcatgtccaacgacgccttcagccagcgccagcaggagatcctgttcaaggccggcatcctcgcgctgttcgccctgctgttcaccttcctcctggcccgccgcctggcggccagcctgtcgcagccgatcagcgccatgggcaccgcggtcaaggccattcaacagggtgacttcaagaccccgctgccgatcgtcgacgatgccgagctgggcgatctttcgcggcatatcaacaacctggccgccggcctcgaacaggccagccgcgagcagcaccaggccatggcccagttgatccagacccgcgaagaagcggagcgggccaacaatgccaaatcggacttcctggcgatgatgagccatgaactgcgcacgcccatgaacggcgtgctgggcatgctgcaactgctcgaaaccaccgaaatgaccgatgaacagcacgaatacgcggcgctggcctccgagtccaccgagcacctgctcaaggtgatcaacgacatcctcgacttctcgcgcatcgagcgttcggccctggagctggagcacatcccgttcaacctcgccgaactgatcggcagctcggcccaggccttccagcacagcgccgcgcagcgcgggctggacctgcagctgcgactgccgcccggcatggagtcgctgcaggtcaaaggcgacccgacgcgcatccggcagatcctggtgaacctgatcggcaacgccttgaagttcaccgagcaaggcagcgtcaccgtcgagccgcaatggcaggccctggaccatgaactgctgtggttcacctgcagcgtgcgcgacagcgggattggcatcagcaccgaaagcctggaactgatgttcaacgccttccagcaggccgacagttcgatttcccggcgttatggcggcaccggcctggggctgccgatcgcccgcaccctggccgaacgcatgggcggcaccctgcgcgcccagagcgaggaaggccgcggctcggtgttcaccctggagatcccgctggcgctgtaccagcaaagcctgccagtgctggcgccgcgggtgcacagcgggcatgcccatggcgaaggacgcaacgtgctgctggtggaagacaacccggtcaaccagaccgtgatccaggccatgctgcgcagcctgggcttcacggtcagcatcgccaccgatggcgcccaggccattcgcagcgccgagagcctgatcttcgatgcgatcctgatggattgccggctgccgctgatcgacggctacgaggccacccggcagatccgccaactgcccggatgcgccgacctgccgatcatcgccttgaccgccaacgccttgcagggcgaccgcgaagcgtgtttgtcggcgggaatgaacgattacctggccaagccgttcaaacgcacggatctgcagcaaattctccaacgctgggtgcagtagcggccacttatcgaccatctgcgactggcgtgaagggcgaaagtgcggcagtcttaggcacccgaacaggcccctcacagggcctgtataataatttcagtgcacaagtgtacattcatgtcccttgtgctgtgactttcaccacaacgcaatagtctatgagtaggctgccggctcgaggcatgaacgcttcgatcggccgggaagatttgccccaccctgccgcatgggactattgaggagctcgcatgaccaaacaaaacgcctttactcgggaagatctgctgcgctgcagtcgcggtgagctgttcggcccaggtaacgcgcaactgcccgccccgaacatgctgatggtggatcgcatcactcatatcagccaagagggtggcaagtacggcaaaggtgaattggtcgccgagctggatatcacccctgacctgtggttcttcgcctgccacttcgaaggcgatccggtgatgccgggctgcctgggcctcgacgccatgtggcaactggtcggcttcttcctgggctggcaaggcctgccgggccgcggtcgcgccctgggctcgggcgaagtgaagttctttggccaggtgctgccgaccgctaaaaaagtcacctataacattcatatcaagcgcgtcctcaagggcaagctgaacatggccatcgccgatggctcggtcagcgtcgacggccgcgaaatctacaccgccgaaggcctccgggtcggcgttttcacctccactgacaacttctaagggttatccgcatgcgccgcgtcgttatcactggtctgggcatcgtttcgtgcctgggcaatgacaaagagaccgtctccgctaacctgcgtgcaagtcgccctggcatccgcttcaacccggaatatgccgaaatgggtctgcgtagccaggtttccggctccattgacctcaatctcgaagagctgatcgatcgcaagatctatcgctttgtcggccacgcggcggcttacgcctacctggccatgaaagacgccatcgccgactccggcctgaccgaagagcaggtttccaacccgcgtaccggcctgatcgccggctctggcggcgcctctaccctgaaccagatggaagcgctggacatcctgcgcgagaaaggcgtcaagcgcgtcggcccataccgcgtgacgcggaccatgagcagcaccgtttccgcctgcctggccacaccgttcaagatcaagggcctgaactactccatcgcttccgcctgcgccaccagtgctcactgcatcggtaccgccatggaacagatccagatgggcaagcaggacatcgtgttcgccggcggcggtgaagaagaacattggagccagtcgttcctgttcgacgccatgggcgccctgtccagcaagcgcaatgacaccccggaacaagcctcccgcgcctacgatgccgaccgtgacggcttcgtcatcgccggcggtggcggcatggtggtggtcgaggagctggaacacgccttggcccgtggcgcgaagatctacgccgaaatcgttggctacggcgcgacgtccgacggctacgacatggtggcgccaagcggcgaaggtgcaatccgttgcatgcagatggccatgtccactgtcgacgcaccgatcgactacctgaacacccacggcacctcgactccggtcggcgacgtcgcggaaatgaaaggcgtgcgtgaagtgttcggcgacaaggctccagccatcagctccaccaagagcctgtcgggtcactccctgggcgccgccggcgttcacgaagcgatctactgcctgctgatgatggaaggcaacttcatggcaggttccgccaacatcgacgagctggacccggaagtggccgacatgccgatcctgaccaagactcgcgaagacgccaccatcaacaccgtgatgagcaacagcttcggcttcggcggcaccaacgccaccctggtcctgaagcgctggcagggcaagtaagccccgccgcttcaccccatgaaaaacgccccgactggttcggggcgttttttattgggcggctgttttcccccgcgcaaaagcacttacaccgagaagcgcgccaccagggtgttcaggtccaccgccagccgtgacagctcctggctcgcggcgctggtctggttggccccggccgaggtctgcatggccaggtcgcggatgttcatcaggttgcggtccacctccctggccaccgccgcctgctcctccgaggcgctggcgatcaccgtgttgcgctcgttgatcagggtgatcgccccggcgatttcctccagcgccgcccccgccgccttggccagctccagggtcgagcgggcccgactgttgctctgctgcatcgagctgacggcctgctcggtgcccagttgaatgccgccgatcatctgctcgatctcctgggtcgattgctgggtgcgatgcgccagcgcccgcacctcgtccgccaccaccgcgaacccgcgaccggcatccccggcccgcgccgcctcgatggcggcattcagggccagcagattggtctgctcggccaccgaacgaatcacatccagcaccttgctgatgccatacaccttctgcgccagctcttcgacctgggaggcgttggcagtcacgtcgtcggccagggactcgatggactgtaccgtctggcgcacctgctcacgcccatgctgggcaatcaggtcggactggcgggaggcttcggacgttgccacggcattgctggccacctcctccaccgcggcggtcatctggttcaccgcggtcgccgcctgttcgatttcctggctctgctggtgcaggccgcgggtggcgtcctcggtcacgcaactgagttcctccgaagcggaagccagctggctggaagagtcggaaatacgccggatggtctcccgcaggctgtgctgcatggccttgagcgcctgcagcaggcgcgccggctcatccttgccactgatgcgaatgtcctcggtcaggtcgccgccggccaccacctcggccacgttcagcgattgcgcgagcggcagcacgatgctgcgggtaagcaacagggccaggacaatggtcatcaggccagccaccacgaccattacgaccacccagaccttggcgttgctgaacaccgccctggccagctcggtggccaggttggcgttgtgccggttgagggccaccagctcattgagggtgcccgccagctcatcggccagctggctcatctcgccattgaccaccgcgaccgcatcctcgacacgcccctgctgcgacagcgccatcacctggttctgatgctcgaggtagcgcttctcggcggccttgtagcgatcgaacagcacacgctcttccggcagcacaatcagcgcgttatagcgctcctgggccaccgtcatgccgcgcttgatctcattgagtttgctttcgttctgcgccagggcctgggggctgcggttgaccagcaagcgcagggtcagcgcacggacccgcagcaggtcctgattcatttcgcccaccgacatcacactgggtagccagttgttgtcgacctcgtcggactgcgcgcgcatgttcgacatctgcaacagggcgaacgcccccaggccgaacaccatcaacgccagcaggccgaagcccaggcccgcgcgcggtgcaatgttgagactcctgatgctcattctccggttccttccaaaagcgctgcattcgccatacagcgggctgctgttgaaggtatcgggtcgcggaaaatttgcttaagacgaaaacgtgatatcaaaacgcccaagcactccgatgcctgggcgtaaacgattcagcgtacggtaaaacgctgctggaccaacaaacggtcgccctggaacaccatgaaacgccactcgcctgggatcacctcatgactctcggtgaactcataggccatgatgtcctgcggcgcgcccggcaccagtttctgggtcacttcgagcttgtcgtgacgctggccatccggggtacggatgcccggcgtgaaatacaacagggtcagcggcacatcctcggccaccttgccggtcaactgataacgcaggccgaacttggtgcccagccgcgcgggcacgatctcggtctgctcgatgttttcgttgctgcgccgcagcacccgctcacccgactgcaacgcggccttcggcccctcgaacacaccatattccaccggtccttcgacacggacttcagcactggcaaggccactgagcatcatcagcgccgccaatgcgcttaaacgggtgaggtgcatatcgcgctccttgattgagatggcgcgagcctatgacgcaggcatgacaggctgatgacaaacctgcatcgccaacgcccgcgcactggagccacccgggatcaacgagcacgcggcagcacggcaaggaagttgtcccgggccaccttgcgcgccacggcctccggcaaggcatcgaggaagggatcgaagccgcgcatttcccgccccagcttattgaatcgcccgacaacgtccgaacccagcatgaaacgctcgggaaagcgctccaccagcttcagccactgcgcccggggcacgccctgctcatccagcagatacggcctgagcacgctccaggacaggtcgatgtagaggttgggataggactcgagcatccgcgccagggtcggcaggagaaaatccagctgcacctgatgccgatggatctccacgctggtgcccgcgtgggcccagataaagcgcgtgtggggatgattgcgcagcggctcttcgatttccgccaggtacagcgggttcttttcgcgcttggaggtgatgttggaatgcagtatcaccggcaggtcgttttccgccgccaggtgatagatccgtgtcatcgcctcgttattggcccgcggcgtatcgccggaggtcagcgcggtcaggtcgtcgtggcgggtgaacacttcgccgatgccctgccatagccccgggttgaggtcgagcatgcgctggatatgggcgtcggagttcttgtcgttggggttgaagccggagaggaacggatgaaaatgctggcgctgctcgggcgtcagacggttcaccgcggcggcgacaatcacatcggtggcgctgtaccagtaggcctcggcgtcgtcgccggcgtagtagcgcggccgcttgggttcgtcttcatgccatttcttggccaccgggataccggaaatcatcacatgctcgatgcgattgtcggccatggccttgagcagcttgtccatgcccgccgactcctggaagaagtcgacgtaatgcaagtgagcatcgctgtaggcgtagtcgcgggcctgggcccaggcgctcggcagcagcaacagcaaggtgctcaggtagatccagtgcatgggcgggctcccgtcggttgacgctgggtagaccctgccccgcaggtgacggttcagaaaaaggggaacgcacggcaagcgtaatgctctataactgcaccacctttcaatgtctgttccgactgcccaccactgcccgaggtccgtcatgactatcaccgtcaacaccgaatccagcgaaggtttccgccacagcatccagatcgatgaccaccaattgttcgccgacctgcccaagaccctgggcggcgaaggttccgcgccggaaccccacgacttcttcgatgccgccctgggcgcctgcaaggccctgaccctcaagctgtacgcgcagaaaaaagagattccgctcaccggcgtcacggtcgaggtcaagcacgacaacagccaggagcagaaaggccaatacgcgctgcacgtcaagctgaccctcaagggcgtgctcaccgacgcccagcgtgaagaactgcatcgcgtcgccgaccgctgcccggtgcacaagctgatgaccaccgccgaggtgagcatcgagacccacctctccgaaggcgccttcagccaatagcgccatggctcgcacaagcgggttatgctcccgggcataacccgatcagcctggaatgcaccatgaacacaccgcttgtgattcgccctcgcgccgaggacgtcgaaggccaacccatcctgcgtccgctgccctcggcccaatgccgcagcgtcgggcccttcgtgtttttcgatcacatgctgcaaacccgctaccccgcgggcaagggcatgaatatccgccagcatccgcatatcggcctgtcgaccctgacctacctgttccaggggcagatccagcacaaggacagcctgggttccgatcaggtggtgaaccagggggatgtcagctggatgaccgccggcagcgccatcgcccatgtcgaacgcaccccgcaggcgctgatcgacagcgacttcagcatgcacggcctgcaggtctggctggcttcgcccaaggcccatgaacaaggcccggggcactacagccatcacccggccgcgaccttgccggtcagcgacaacctcggagtcaagatccgcatgatcgccggcagcggtttctgcctggaatcgccggtgccggtgctctccccgaccctgtatgccgaaatacagttgcagaccgcgaccaccttgctgatccccgccgaacacgaggagcgcgccctgtacgtgctcgaaggcgacgcccagctggatggcgagcccgtcgagccgcatgcgctggtgatcctgcccaccggaaccactcccaccctgttcgccgacagcgattgccatgccgtgctgttcggcggcgcgccgctggacggtccgcggcggatcaactggaacttcgtctccagcgacccggcgcgtatcgatgaagcccgccagcgctgggccgtcggcgactggccgacggtgccgggggaaagcgaaagaatcgaactgcccaagggcaaaggctcgccgtcacccctgtagcgccgggccaggcttcccccgccgcctggttgcgcaaccaggtaccggccggcgcgagcggttgcgggtagccggatcccggcctatggtccaagcgatgcattgcctgcgaccggcgcgcgatgattcgccgtgggtcgcccatccagcgcagctttgcgcagcgaggtgacgacatgccgaacgactcccgtcccgccgtgctcgaactgatcggcaacacgccgctggtgcgtgtcagccgtttcgataccggcccctgtacgctgtttctcaagcttgaatcgcaaaaccccggtggctcgatcaaggaccgcatcggcctggcgatgatcgacgccgccgagcgcgatggccgcctgcgacccggtggcaccatagtcgaagccaccgccggcaacaccggcctcggcctggccctggtcggccgcgccaagggttatcgggtggtcctggtggtgccggacaagatgtccaccgagaaggtcctgcacctcaaggcgatgggtgccgaagtgcacatcacccgctccgatgtcggcaagggccaccctgactactaccaggatatggccgcgcgactgaccaaggagattcccgacgcgttcttcgccgatcagttcaacaacccggccaacccgctggcccacgaatgcagcaccgcgccggaaatctgggcgcagacccagcatgacgtggacgccatcgtggtcggcgtcggctcggccggcaccctgactggcctgacccggttcttccgccgggtgcagccggacctggtcatggtcctggccgatccggtcggctcggtgatggccgaatacagccgcagcggcgccctcggcacgcccggttcctgggcggtggaaggcatcggcgaagacttcattccatccatcgccgacctttccagcgtgcgcaaggcctattccatcagcgacgaggaaagtttcgagcacgcccgccagttgctgcgcgccgagggtattctcggcggctcttcgaccggtactctgctggccgcggctctgcgctactgccgcgagcagactgagccgaagcgggtggtcagcttcgtctgcgacactggcacccgctacctgtcgaagatctacaacgaccaatggatgaacgaccagggcctgctgcaacgcaaaggctacggcgacctgcgcgacctgatcgcacgacgcttcgaggacggccgggtgatcagcgtggggccggacgataccctgctcaccgccttccagcgaatgcgcctggccgacgtctcgcaactgccggtgctggtagacgggcagcggctggtcggggtgatcgacgagtcggacatcctgctgggcgtgcacgaagatgcttcacactttcgcaagaccgtggccagcgccatgaccgaccagctggaaaccctgcctcccggcgccagcctggccgaactggaggcggaactcgaccgtggcctcgtggcgatcatcgccgacgcttcgggcttccacggcttgattacccgggtcgacatgctcaaccacttacggagatcactgccatgagccaagatgaaaccggcgcgccacgcgccttcgccacccgggtaatccatgcggggcaaacgccggacccttctaccggggcgctgatgccgccgatctacgccaactccacctatgcccagcagagccccgggatgcacaaggggctcgattacgggcgctcgcacaatcccacgcgctgggccctggagcgctgcgtggcggacctcgagggcggcacccaggccttcgccttcgcctccgggttggcaacgatttccaccgtgctcgaactgctcgacgcgggcgcgcatatcgtttccggcaatgacttgtacggcggaacgttccgtctcttcgacaaggtgcgccaacgcagcgccggccatcgcttcagcttcgtcgacctgaccgatctgtcggctttcgaagcggcgctgcaggacgacacgcggatggtcatggtcgagaccccgagcaatcccctgctgcgcctcaccgatctcgccgccatcgcgcgcatctgccgggctcggggcatcatctgcgtcgccgacaacacctttgccagcccgtggatccaacgtccgctggaactgggcttcgatatcgtgctgcactcgacgaccaagtacctcaacggccattccgacgtgattggtggcatcgcggtggtcgggcagaaccccgacctggccgaacgtttgggcttcctgcagaacgccgtgggagcgatcgccgggccgttcgacgccttcctcaccctgcgcggggtgaagaccctggcgctgcgcatggaacgccactgcagcaacgccctggagctggcgcaatggctggagcgccagccacaggtggcccgggtctactacccgggcctgccgtcccacccgcagcacgcactggcacggcggcagatgcacggtttcggcgggatgatttccctcgacctggactgcgacctggccggcgccaggcgttttctcgagagcgtgcggatcttcgccctggccgagagcctgggcggggtggaaagcctgatcgagcacccggcgatcatgacccacgccagcattcccgcgggcatccgggcgcagctcggcatcggcgatgggctggtgcgtttgtccgtgggcgtcgaggatgtcgaggacctgcgcgccgacctggcccaggcactgacgcggatctgaatggccgacaggcacaaaaaagcccgcctggcgtacaaggcggctcactgagagccgtattgcatcgccaggcgggcttgtggttcccgggctcagcccttgaacacttcatccagcaggttgtgcatcgaggtgaaggcacggcccgcggtcttggcgtcgtacatcatcgttcccggcacattggcgtgcggatcggtgaaggaatgcaccgcgccgccatagctcagcagttgccaatccacgcccgcggcattcatttcctcttcgaaggccggcaattgctctttcggcaccagcgggtcggaagcgccatgcagcaccagcaccgaacccttgatgttccgggcgtcggccgggttcggcgtatccagggtgccgtggaacgacaccgcggctttcagcggcgcaccactgcgcgccagctccagggagcagcagccgccaaagcagaagccgaaggtggccagccgggccttgtccaccgctgcttcctgctggctttgcagcgcctcgaaggccgcctgcatgcgcttgcgcagcaaggcccggtcattcttcagcggcatcatcgcggcgcccgcctcgtcaccgttgctcgggcggacctgttgcccgtacaggtcggcgatcagcaccacataccccttggcggcgaccgcctcggcgatcttctccgcaccggcgccgacgcccatccagttcggcgccatcaacagccccggacgcgggccctgctggctggcatcgaacgccaggcggctttcataggattgaccatcaatctggtagaccagggaacgaacagtgacttggctcatttcagactcctgattcaaaaacaccggaatgaaaaaacccgccgaagcgggtttttatacaacgcagttaaaccgacagttcaaccagcagcttgttcaggcggcgcacataggcggccgggtctttcaagctgtcgccggcagccagggccgcctgatcgaagaggatgtgcgacaggtcgccgaagcgctcgtcgctctgctcgccgtcgagtttctcgatcaacgggtgagccgggttgaattcgaagatcggcttggaatccggcaccttctgcccgctggcctcgaggatctggcgcatctgcaagcccaggtcctgctcgccgatcgccaggatcgccggggagtcggtcaggcggtgggaaacccgcacttcgctgacggtatcgcccagggcggtcttgatccgctccaccaggccttccttgctcttggcgacttcttccgcggccttcttgtcctcttccgagtccaggttgcccaggtccaggtcaccccgcgccacgtcgacaaaacccttgccgtcgaagtcgctcaggtagctcatcagccactcgtcgatgcgatcggtcagcagcagcacttcgatgcctttcttgcggaagacttccaggtgcgggctgttcttgacctgcgcgtaggtttcgccggtgaggtagtagatcttgtcctggccttccttggcgcgtgccaggtactcggccagggaaacattctgctcgccgtcgtcgccctgggtggaggcgaagcgcagcaggccggcgatcttttccttgttggcgaagtcttcggccgggccttccttcatcacctggccgaagtttttccagaagcccttgtattgctcaggctcgttcttcgccagtttttccagcatgtccagcacgcgcttggtcagcgccgacttcatggagtcgatgatcgggtctttctgcaggatttcccgcgacacgttcagcgacaggtcgttggaatcgaccacgcccttgatgaagcgcaggtacagcggcaggaaggattcggcctggtccatcacgaacacgcgctgcacgtacaacttcaggcctttcggcgcttcacgctggtacaggtcgaatggcgcacgggccggcacgtacaacagcgaactgtattccagcttgccttcgaccttgttgtggctccagctcagcggattctcgaagtcgtgggcgatgtgcttgtagaactcctggtattcctcgtccttgatttcggtacgcggacgggtccacagggcactggcgcggttgacggtttcccattcctgcgcaggcttctcctcgccctctgcggcagcggcctctttcggcagctcgatcggcagggcgatatggtcggagtacttcttgatgatgttgcgcaggcgccagccgtcggcgaactcgtcttcgccggacttcaggtgcaggacgatgcgggtaccgcggtcggccttgtcgatggtcgcgacttcgaactcgccttcgcccttggaggaccagtgcacgccttcgctggcgtcaaggccggcgcggcggctgaagacatcgaccttgtcggcgacgatgaaggcagaatagaagcccacgccgaactgaccgatcaggtgcgaatccttcttctggtcgccggtgaggtttttcatgaaatcggcggtgccggacttggcgatggtccccaggtgggtgatcacatcgtcccggctcatgccaatgccgttgtcttcgagggtgacggtcttggcgtccttgtcgaagctcacacggattttcagctccgcgccaccttccagcaactcaggcttggacagggcttcgaagcgcaatttgtcgacagcgtcagaggcgttcgagatcagttcgcgaaggaagatttccttgttggaatacagcgaatggatcatgaggtgcagcagttgctttacctcggtctggaagcccagggtttccttttgagtttccacactcatggtcatcaaactccaatcagatggcataagccgcgcccggagggcttacggcgggatgtccacagagttgggggctatacctgagatttcaaggccctggactttcttcgagtttgaaatgtgcgcgggcggtggcaatcggctcctctgcggagctctgccaggcggtgatggccacgttcgccacccgccgtccctggcggcagacctggcatcgggcataggtatcgcgaaattgcccggcccgcaggtaatcgagggaaaagtcgatgatcttcggcacgcccggcgagccggtgccaatcaacagatgcagggccgcggcgagctccatgaaaccggcgatcaccccaccgtgcagggccggtagcagcgggttgccaatgttgtcgcggttggcgggcaggcgaaacagcaactcatcgccctgccgcgaacactcgatgccaatcagcctggcgtagggaatcaattgcagcagcgcggcgtaatcgccttgctggtgggcatgctgcacttgcttctggaaatcgtcgctcatggccgctcacccttgatggcgccggcaaaacctttgctgcccttgatgcccttgcccatgcgcatgaaggtgcccaccacatgggcaacagggtgctcggggtcgtcctgataggcaaaaccgcgggtgaaaatcacatcggtggtcacccggtagcactgggcaaagccatacacactcttgcccggctgcgccgggtgcatgtaatcgatgcgcaggtccagggtcgggcagacctcgaactccggcaggacgcacaacgtggccatgccacaggcggtgtccatcaacgaggtcagcgcgccaccgtggatcactccggtctctgggttgccgactatctgcgggctgtaaggcaacatcagggtgatgccgtcttttgaggcgctgtgcacgctcatggccaatacctggcaatggcgcagcgccgacaaaaaccgcgtcgcacgctcaaaaacagggttctgctccataaggaaattctctagttggtgtcaaaaccgctcggttaacgcgacaggtaaaagttccatattgccggcactttatatatctttaactttcaaggaacttaacctgtagagccatgctcgaaaggccagaagatatcttcaataaggagaaacaccccatgcgtaagactttagctattgccctgatgctgaccgcttccctcggtctcgctgcctgcgataaaaaatccgaggacaaagctcaagatgccaaccaacatgctgagcaagctcaacagaaaatgaatgaagctcaggataaagtgaacgaagctgcaaaagaaaacgccgaagcagccaaagatcaggttgaatcgaacaaagcagcggctgaagaagctgccaaggaagccgctcctaaaaccaactaatccggttttagtgcagcaaaaagaaagcccgcctagtgcgggctttactttgtctgcaataacgctaagccaacaggctgcgaaaagtcggactaagcatcagcagcaatgagcagagcagaccgataaaccagaccagactgcgctgccaggcaagatccgcccaatagcacagcagatagataacccgcgtgatgacgaagacgatcgccaggccgtcgatcaaccagccctgagtctgggtggtatgggccatcagcaccccgaccgcaaataacatgaaggcttcgaaactgttctggtgcgccgccactgcccgggcgccgaaccccgtgagctgtgtctgttgctggcgtggcaggtgattgtcgtagccgccctgctctttcatcgccctggctaccggtatgcgcgccacgtaaatcaacagcgcgctgataaacacacaccagaaagcaatactcatcaggctatctccttgttcgcctcgggcaatggcgcctctgtaggggtatagaccatcacatccaacacgtcggaatgaaactcccggcggtacagcaccagcaccacgcccgcgctcatcagcatgaacagccaggggctgacgaaccaggccagcatgctcatgccgaagtaataggaacgcaggccgaagttgaactggttggcggccatggaaatcacccgcgcggcccgcattgcaaaggcttttcgctcctgttcggaaacatgccgctcaccgatcatcggcgccgagcccacgagaatggccgcgaagttgtactggcgcatgcaccagctgaaggtgaagaaggcgtagacgaacaccagggccaggcacagcagcttgatctccgacatgccctgggaggcctgctgcaccatgggaatgtcggccagcagcgacaccgcacgctcggaagcgccaagcacggtgaggataccggcgaggataatcagggtgctggaggcaaagaacgaggcgttgcgctccaggttgccgatcacgctggcgtcggcaatgcggttatcgcgcagcagcatgcggcgcatccagtcttcccggtacaggtgcagcacgctggccaggcacgcggtatcgcggcccttccatgtggcgtagcgggtgtagccgccccagcagatgacaaaccagagggcggcgatgagatggatcaggttggcttcgacgaacgacatgcaggttcccgggtaggcgttggcagagtgcggatacaactggcactgcttcgacgttgatcgaggaaaaaagacaccatcggccgcccataaaaaatgccccgcatcgctggatacggggcattttcatggctactcggtgcccgcttgtgacaggccccggcagatagcggtctaggccagcgcttcgctgcgcttgcccagcaggcggtcgcaggcgaccgcgaccaccagggtcatgaccgaaggcaccagccacgccaggccctgctcgctcagcggcaggtgcatcaactgggttggcatccagtccgccaggccggcgcccttgagggcgtcgatcaggccgaacaggaaggacaccagcatcaccggaccgacgatgcggccttgctcatgccagaagtccttgcagaagctcagggccaccagggcgatgcacggcgggtagatggcggtcagcaccgggatggagaaggcgatcagcttggtcaggcccaggttggacaccagcagcgagaacgccgccaggatgatcaccagggtcttgtacgacagcggcagtacgcggctgaagtactcggcgcaagcgcaggtcaaaccaaccgcggtcaccaggcaggccagggaaatcagcacggcgaggaagccactgcccagggaaccgaaggtgtgttgcacataagcgtgcagcaccgccgcgccattggtggcaccggccgcgacttcgtgactgcccgagcccaggcggaacaggctgacatacaccagcgccaggccgacaccggcaatcagcccggcgatgatcgcgtaacgggtgatcaggcggggcgactcgacaccgcgggagcggatggcgttgacgatgacaatgccgaacaccagcgcgcccagggtatccatggtcaggtaaccattgatgaagccctgggagaacggtgccgcaacgtattcgggcgtcgcggtaccgatatcaccggccggcaaggcaaacgcggcgatgcccagtacggccagggcgatgatcttcagcggcgcgaggaaacgcccaacggtgtccagcaggcgtcccgggtaaagggagatgaaaaacaccagcaggaaatacgctgagctatagaggaacagcgccagcgggctttcgccggtcaggggcgccaggcctacttcgaaggacacggtcgcggtacgcggcgtcgcgaacaacgggccgaccgccaggtagcagaccgccgccagcaggccgccggcgatcttgccgatcgggctgctcagcgcgtccatcgccccgccgaccttggccagcgcaacgacggtcaccactggaaggcccacggcggtgatcagaaagcccagcgccgcgatccagacgttaggtccggactgcaagccgacgatgggtgggaagatgatattgccggccccaacgaacagggcaaaggtcataaaacccagtgccagaatgtcctggcctttcaacactttcattaaggaaataccacactactgaatcggaatttagagagggatttcccttatgggtgagggaaatgctgtcggtccgtataggactgacccgtttagcgcgcggcttccttgtgggatgcagacgcaaaagaggcggctagactaccgaatttgtaagacaaacgcactgttagagggcgaactgtccgatcagcgacatttgtgtgtcgcgtttatatagataaatagccgtttgccatgatcgcgagccctttccgacagccagaaagcacaaaggccacccgaaggtggcctttgttggtggagcgtcagctaagcgcgaggcttacttgacagcccagccagtcagctcggccaaggccttgccgatatctgccagcgaacgcacggttttcacgcctgcgtcttgcagagcagcgaatttctcgtctgcagtgcctttgccgccagagatgattgcgccagcatggcccatgcgcttgcccggaggagcagtcacaccagcgatgtaggaaacaaccggcttggtcacgttagccttgatgtaggcagccgcttcttcttcagccgaaccgccgatctcaccgatcatcacgatcgcttcggtcttcgggtcttcctggaacagcttcaggatgtcgatgaagttcgagcctgggatcgggtcaccaccgatgccgacgcaggtggactgaccgaaaccggcgtcagtggtctgcttcacggcttcgtaagtcagggtgccggaacgggaaacgataccgaccttgcctggcaagtgaatgtgacctggcatgatgccgatcttgcattcgcctggagtgatcacgcctgggcagttagggccgatcagggtaacacccagctcgtcgcacttgaccttggcatccagcatatccagggtaggaatgccttcggtgatgcagacgatcagcttgatgccgccgaaagccgcttccaggatggagtccttgcagaaaggagctggaacgtagatcacgctggcggtggcgccagtggcagctacagcgtctttcacggtgttgaagacaggcaggcccaggtgctcggtgccgcccttgcccggagttacgccgccaaccatcttggtgccgtattcgatggcttgctgggtgtggaaactaccttgcgaaccggtaataccctggcagataactttggtgtctttattgatcaggacgctcattatttgccctccgcagctttgacaacttgttgagcagcgtcggtcaggctggtagcagcgatgatgttcaagccgctttctgccagtactttagcgcccagttcagcgttgttgccttcgaggcgaacaacaaccgggattttcacgccgacttctttcactgcaccgatgatgccttcggcaatcatgtcgcaacgaacgatgccgccgaagatgttgaccagtactgcagcgacgttggtgtcggacaggatgatcttgaaggcttcggtcacgcgctctttggtagcaccaccacctacgtcgaggaagttggctggcttgccgccgtgcaggttgacgatgtccatggtacccatggccaggccggcgccgttgaccatgcagccgatgttgccttccagcgctacgtagttcagttcgaacttggcagcgtgcgcttcgcgcggatcgtcctgggacggatcgtggaaagtcttcagcttaggctgacggtacatggcgttggcgtcgatgttgatcttcgcgtccaggcagtgcagatcgccatcagccttgatcaccagcgggttcacttccagcagtgccagatcgtggtcctggaacagcttggccaggccgacgaagatcttggcgaactgagtgacttgcttgccttccaggcccagctggaaagccagctcgcgaccctggaatggctgagcgccaaccagtggatcgatagtagccttgaggattttctcaggggtgtcgtgagcgattttctcgatgtccacgccaccttcggtggaagccatgaacacgatgcgacggctcgaacggtcgacgacagcgcccaggtacagctctttagcgatatcagtgcacgattcaaccaggatcttggtgactggctggccattggcgtcagtctggtaagtcaccagacgcttgcccaaccactgttgagcgaatgctttagcgtcttctttgctgcgaaccagctttacgccgcccgctttaccgcgaccaccggcgtgaacctgggctttgacaacccactcggagccgccgatcttgtcgcaagcttctgctgcttcttccggggtgtctaccgcgtagcctttggatactggcaggccgtattcagcgaacagctgcttaccctgatactcgtgaagattcatgctttttaccgtcttcgttaggtactgcgcattcggcgctgcgctcttgatgagtgccgcgccacctgtgaccgctcctcaccggactcccctgccccgcatccgcagcctgggcttcggcacagcgcatgaagattcccgtgaggtcgagtccagcggacgttccgcggtgagtcttgctcgcaaggctcacgacgggcaatccgccgtggtttcttattgtcttaacgctttttgcggttggcgatgtggatggcgccgccattcactgccagtgctgcttcgtgcagggcttcggacagggttggatgggagaaaaccatcatgcccaggtcttcggcgctggtgccgaattccatgccgatcgcaccttgctgaaccaattctgccgcgcttgggccgatcacatgaacgcccagtacacggtcagtcttggcatcagcgatgacttttacgaaaccgccggtgtcgttggctgccatggcacggccgctggctgcgaacgggaaggtgccgacgttaacttcaacgccttcagctttcaaggcctgctcggtcttgccgacccacgcgatttccgggtgagtataaataaccgaagggatcaggtcatagttcatctgagccttgtggcccttgatgcgctcgacgaccatgatgccctcttccgaggccttgtgagccagcatcatgccgcgaaccacgtcgccgatcgcgtaaacgcccggtacggtggtggcgcagtgatcgtcgacgtgcacgaaaccgcgctcgtcgagggtcacgccgcaatcggcagccagcagatcagtggtcactggacggcgaccaacggctacgatcagcttgtcgaaagtgatgttctgttcgccgttggcatcggtgtaggtcacgaccacttcttcgccgttgaccttggagccggtgacgcgagcgcccagcttgatgtccagaccctgtttggtcagggttttcagcgcttccttggagacggcggtgtcggcagccatcaggaaggtgtccagggcttccaggacagtcacttcagcgcccagacgggaccataccgaacccagttccagaccgatcacgccagcgccgatcacgcccaagcgttttggtacggattggaattccagggcgccggtggagtcgacgatcactttctgatcgaccggagccggtggaatgtcgattggacgggagcctggcgccaggatgacgttctcggcttcgatcacttccaccgagccgtcaggcttggtgacttcgactttcttgccggccagcagtttgccgtggccctggatggaagtcacgccgttggccttgaacagggtggcaacaccgctggtcaggtttttcacgatgttggccttgcggccgaccatcgccgggacgtccatggacacgccagcgtggctgataccgtggatcgcgaaaccgtcttgggcttcgtggaatttccaggagctgtccagcagcgccttggaagggatgcagccgacgttcaggcaagtaccgccgagggccagcttgccctccttgtcggtatatttctcgatgcaggcagtcgtgaggccgagttgcgctgctttaatggcagctacatagccgccagggcctgcgccaatcactaccacgtcgaatttctgagtcatgtgtcattccttctcgaatcaaaccggacggcctcttgtggaggccgtcgtgggacgaagctgttcgtttcggcgaaaggccgatcatcgctgatcggcccatgctacgaaatcagatatccagcagcagacgagccgggtcttccagcaggttcttgatggtaaccaggaaggtcactgcttctttgccgtcgatcaaacggtgatcgtaggacagagccaggtacatcatcggacggataaccacctgaccgttgatcgccatagggcgctgcagaatgttgtgcatgcccaggatcgccgcttgtggcgggttgacgatcggagtcgacatcatcgaaccgaaagtaccaccgttggtgatggtgaaagtaccgccggtcatctcttccatcgacagtttgccgtcacgggctttcttgccgaaggtggcgatgccgccttcgatttcagccaggctcatcagttcggcgttacgcagaaccggaaccaccaggccgcggtcgctggacacggcaacaccgatgtcggcgtagccgtggtaaacgatgtcggagccgtcgatcgaggcgttgaccgcagggaaacgcttcagcgcttcggtagcagccttgacgaagaacgacatgaagcccaggcgtacgccgttgtgggacttctcgaacagatccttgtacttcgaacgcagggccatgacttcggtcatgtcgacttcgttgaaagtggtcagcatcgccatgttcgactgggcttcgaccagacgctcggcaaccttggcacgcaggcgggtcatcggaacgcgcttctcgacgcggtcgccagcagcgaataccggagcagcggcggcaggagctgcggccttggcaggcgcggcagccggagcggctttcttggcagcaacggcggcaaccacgtcttccttggtcacgcggccgcctttgccggtaccggcaacggaagcgatgttgatgccgttctcttcggccagcttgcgcgcggcaggagcagcgattggatcgtcttcgccttcggcggcaggagctgcggcctgggcggcagccggtgcggcagcggctggagcagcagcggcggcagcgccttcagcgatggagcccagaacttcgtcggacagaacggtgtcgccttcgttcttgacgatagcgcccagcacgccgtcagcggtggccagaacttccagcacgaccttgtcggtttcgatgtcgacgatcagttcgtcgcgcttgacggcgtcgcccggttttttgtgccaggtggcaacggtgccatcggcaaccgattccggggaaatgggggctttgatctcgatagccattatctgtggttccttaaattcggtttcaggtgcgcgaaggcgttaaacagtgaaagcatcttgcagcagtttttcctgctgctcggcgtgcatcgacgcgtaaccgcatgcaggtgcagcagaggcttcacggcccgcgtactcaagtacgagcgacttgtcgtgattgccaacgatgcggcgcatgtggtgctggctgcagtaccaggcaccctggttcatcggctcttcctgacaccaaacgacatgcttgaggttggtgtacggagccaggacttcgttcaagtcgtcctcagggaatgggtacagctgctcgatacgcacgacggcgatgtcgtcgcggccttcggcacggcgtttttccagcaggtcgtagtagaccttgccgctgcacagaatcagacgattcacgtcttttggatcctgagcatcgatttccggaataacggtctggaacgaaccttccgccagatcttccagggtcgagatggccagtttgtgacgcagcagcgacttcggagtcaggaccaccagcggcttgcgcagcgggcgaatcacctgacgacgcagcaggtggtagatctgggccggagtggtcggcatgcagacctggatgttgtgctcggcgcacagctgcaggtaacgctccagacgagccgaagaatgctccggaccctgaccttcataaccgtgcggcagcagcatggtcaggccgcagagacggccccacttgtgctcgccactggtgatgaactggtcgatcaccacctgggcaccgttggcgaagtcgccgaactgggcttcccagatcaccagcgcgtttggcgtggtggtcgagtaaccgtattcgaacgccagtacggcttcttcggacaggaacgaatcgtacagatcgaaacgtggctggccgtcgtacaggtgctgcagcggaatgtaggtgctggcgtctttctggttgtgcaggaccgcatgacggtgcgagaacgtaccgcgaccgatgtcctggccggtcatgcggatcgggtgaccttcgaacgccagggtcgcgtatgccatggtttcggcataaccccagttgatcggcaggccgccggcttgcatcttctgacggtcttcgtagatcttcgcgacctggcgctgaaccacgaagccttccggcagctccagcagcttggcggacagttcctgcagggtcttcagatcgaaggtggtgtcgtgacgcgcagtccaggcgtggcccagatatggacgccagtccacgaacagctctttgttcggctctttgaccaggctcttcactacgtgcaggccgttgtccagcgcgttgcggtattcgtcgactttcgcctgaacacgctcggcgtcgagcacgcttgcctggaccagacgatcggcatacagctcacgggtggtgcgctgcttggcgatctgctggtacatcagaggctgggtgccgcttggctcgtccgcttcgttgtggccgcgacgacggtagcagaccaggtcgatcaccacatcgcgcttgtactgcatgcggtagtcgatggccagctgggtcacgaacagtacggcttccggatcgtcaccattcacatggaggatcggcgcctggatcattttcgcgacgtcggtggcgtactcggtggaacgcgagtccagcgggttgctgatggtgaaaccgacctggttgttgatcacgatgtgcacggtgccgccggtcttgaaaccgcgggtctgcgacatctggaaggtttccatcaccacgccctgacctgcgaaagcagcatcaccgtggatggagattggcagaaccttgtcaccggtctggtcattgcggcgatcctgacgggcgcgcaccgaaccctcgaccactggcgaaacgatttccaggtgggacgggttgaaggccatggccaggtgaacttcaccgccggtggtcatcacgttggacgagaagccctggtggtatttcacgtcaccggagcccagctcgaccttcttcttgccttcgaactcgtcgaacagctcgcgcgggttcttgccgaaggtgttgaccaggacgttgaggcgaccacggtgggccatgccgatcacgacttccttggtcccgtaggaaccggaacgctggatcagctcgtcgagcatcgggatcaggctttcgccgccttccaggccgaaacgcttggtgcccgggtacttggtgcccaggtatttttcgaggccttcagctgcggtgacgcgctcgagcaggtgacccttgatatccgtggagtaggtcggacggccgcgtacgctttccagacgctgctggaaccactggcgctgttcggaatcggtgatatgcgtaaattcagcgccgatggtgcggcaatatgtctgctgcaacgcttcgtgaatttcgcgtaggctcgcttcctctttgccgatgaacaggtcgccggcacggaaggtcgtatcaagatcggcattggtcaagccgtaatgattgattgacaggtctgcaggtgcaggacgctgccacagccccagcgggtccagctgggctgcctggtggccacgcatacggtaggcctggatcaatcgcagcacttcaacttgcttcttctcgtgctcgctgctcacgctaccggcggataccggctgggcgcggcgctggttctttgccagcaacacgaaatgatcgcggattgtcgagtgcgaaacatcgatggcagtgctgccgtcggtaggcaacttctggaagtaagtgcgccactcttctggcacagcgttagggtcgtgcaggtagagctcgtagagctcttccacataggcagcgttactaccggataggtaggcgctgttccacatgcgctgcatcacgctttcttgcatgcttggtcaccctcggttaggggaacaccaccggcgaagacaccgagcaaacttgcaaaagtccgagtgcagcgaccaaaacaagccacttaggatcacgctgatagtccgggtaccagcccggatgcccctgcttgtctcatttcttcaaaatacgagcggcaactttgtgagctgctgctcagcttaaaactacggcgccggttgaagcctgcgccgtagcctctacgggtacagcggtcctgcctttacaacaactgggttacagcagctgaatcacacgccgctcgagagcagcatgttacgtatgtgaccgatggccttagtcgggttcaggcctttcggacaaacgttgacgcagttcatgatgccgcggcagcggaatacgctgaacggatcatccagcgaagccaggcgctcggacgtcttggtgtcgcggctgtctgccaggaagcgataggcttgcagcagggcagctggacccaggaacttgtccgggttccaccagaaggacgggcaggaagtcgagcagcaagcgcacaggatgcactcgtacagaccatcgagcttttcgcgctcttcaggggactgcagacgctcgatggccggagccggcgtgtcgttctgcaggaatggcttcaccttctcgtattgcttgtagaagatgctcatatcgacgaccaggtcacggataaccggcaaacctggcagcggacgaacaaccagcttgttgttcttcaccacggcagacagcggcgtgatgcaggccaggccgttcttgccgttgatgttcatgccatcggaaccgcaaacgccttcacggcaggagcgacgataggagaaaccttcgtcctgctctttgatcagcgccagtacgtccagcaccatcagatccttgccaccggtgtcgacctggaaaacctgggttttcggcgcggagtcggtgtcagggttgtaacgataaacttcgacttgcaacatatcgatcaccctttagtaagtccggacttttggctcaaaagtcggaacagtcttcggcgagaagttaacggcacgcttggcaacgcgcttctcacccgggaagtacagggtgtggcacagccagttttcgtcgtcgcggtcttcgaagtcttcacgggcgtgggcgccgcgggactctttacgcacttcggcagcgatggcagtggcttcggccacttccagcaggttctgcagttccagtgcttcgatacgtgcggtgttgaacgcctgcgacttgtcgttgatcttgacgttggcgatgcgggtacgcagctcggccagctgggcgatgcccttctgcatgtattcgccggtgcggaatacgccgaagtaattctgcatgcagctttgcagctcgcgacgcagggtagccacgtcttcgccgtcggtacgctcgttgagggcggacagacgcgccagggccgcattgatgtcggcgtcggtggcgtcgtcgtattcgataccgtcggtcagcgctttttccaggtgcaggcctgcagcgcggccgaataccaccaggtcgagcagcgagttgccgcccagacggttggcaccgtgaaccgatacgcaagccacttcacccactgcgaacaggccagggatgatttcgtcgttgccttcggcgttctgggtgatcgcctggccatgaatgttggtggcaacgccgcccatcatatagtggcaagtcggaacaaccggaaccggagcaaccaccgggtcaacgtgagcgaaagtcttggacagttcgcagatacctggcagacggctgtgcagcacttcctcgcccaggtggtcgagtttgagcatcacgtggtcgccattcggaccgcaaccgttgccggcgatgatttctttcaccatcgaacgggcaacaacgtcacgaccggcaaggtccttggcgttcggagcataacgctccatgaaacgctcgccgtgcttgttgatcaggtaaccgccttcaccacggcaaccttcggtaaccagtacaccggcgccggcgatgccggtcgggtggaactgccacatttcgatgtcttgtaccggcacgccggcacgcagcgccatgccgacaccgtcaccagtgttgatcagggcgttggtggtggatgcgtagatacgacccgcaccgccggtcgccaatacggtggctttcgcgcggatgtaggtggtttcgccggtttcgatgcagatggcgatcacaccgacgaacgcgccgtcctggttcttcaccaggtcaacggcgtagtactcgttcaggaaggtggtgccggctttcaggttgccctgataaagggtgtgcagcagcgcgtgaccggtacggtcggaagccgcgcaggtacgggcagcctggccgcctttaccgtagtccttggactggccgccgaaaggacgctggtagatacgaccggtttcggtgcgggagaacggcagccccatgtggtccagctcgaaaaccgcggccgggccttcctgacacatgtattcgatagcgtcctggtcaccgatatagtcggaacccttgacggtatcgtacatgtgccagcgccagtcatcgttcgggtcggccgacgcgatggcgcaggtgatgccgccctgggccgacacagtgtgcgagcgggtcgggaacaccttggtgatcactgcagtcttgtgtccgccctgggccagctgcaatgcggcacgcatgccggcaccgccgccaccaatgatgatggcgtcgaaagaaatcgttggaatgttagccatgaatcagataccccagagaatctgcacaccccagacgaagtaggcgaacattgcaacgccgcatactgcctggaaaaggaaacgtactgcagtcgccgatttgcccagcgccatcggcgtcaggtagtcggtcgaaatggtccacatgccgacccaggcgtgagcgcccagagcaaccatggccagcaggctgaagatacgcatccagttgttggagaacagtgcgtgccattgctcgtagccaaggcccgggttcgcaacgaggtatccgatcaggaagatgaaataagccgcgagaacgaccgcagacacacgctgtgccatccagtcatagaggcccgaacgcgacaggttcgtgacgttagttaccatatccaaactcctgccagaacgattaccaccacggatacggcgataacgattttagagcccagcttgccgccttccagcgtctcaccgatgcccatgtccatgatcaaatggcgcacaccggcaaccaagtgatacagcaaggcggacaggatgccccaaatcactagcttggctagcggactggtcagacacgctttcacctcgccgaagccttcctcggagctgagcgacttgtccaatgcataaagcatgatggcaaggctcacaaagaggatgacaccggaaatacggtgaaggatggacgtgtaagcagtgactgggagtttgatggtccttaggtctaggtttacaggtcgttggctattcacggcttttttcacactgaagagcccctaacaatcagggcaaagttgttggggagtgcactggtcaggtacccaccacccagggagtgacgacccccatcaaaccgggcccgaaagcccatggcggtcggtggccgagtatagacagttaggctactaatgacaacgcaatcaccttcccctaatagctcattgcgttaggcggataaaaggcgtaaatggcggggaatttcgaggaaaaagtccggttaaagccttctggggcaagactttaggcaaattgacattcggatttatctcactatagtggtgcgggccctgcgtggggggtctgtctgatgatttcaagcataaataggaggccacatggctgacaaaaaagcgcagttgatcatcgagggcgcagcccccgtcgagctgcccattttaaccggcaccgttggtcccgatgtaatcgatgttcggggcttgacggccacgggccgcttcacctttgacccgggtttcatgtcgaccgcctcctgcgagtcgaaaatcacctatatcgacggcgacaacggcattctgttgcaccgcggctacccgatcgaacagttggctgaaaagtcggactacctggaaacctgctacctgctgctcaacggcgaattgccgaccgcagaacagaaggcccagttcgtcggcaacgtgaagaaccacaccatggttcacgagcagttgaagaccttcttcaacggcttccgtcgcgacgcccacccgatggcggtcatgtgcggcgtagtcggcgccctctctgccttctaccacgactccctggacatcaataacccgcagcatcgcgaaatctccgcgatccgcctggttgccaagatgccgaccctggccgcgatggtttacaagtactccatgggccaacccatgatgtacccgcgcaacgacctgtcgtacgcggaaaacttcctgcacatgatgttcaacaccccgtgcgagatcaaaccgatcagcccggtgctggccaaggctatggaccggatcttcatcctccatgccgaccacgagcagaacgcatcgacctccaccgtacgcctggcgggctcctcgggcgccaacccgttcgcctgtatcgctgccggtatcgccgcactctggggcccggctcacggcggcgccaacgaagcggtactgaccatgctcgacgaaattggcgatgtctcgaacatcgacaagttcatcgctaaggccaaggacaagaacgatccgttcaagctgatgggcttcggtcaccgcgtctacaagaaccgcgacccgcgcgccaccgtgatgaagcagacctgcgacgaagtgttgaaggaactgggcatcaccaacgatccgcaactcgaactggccatgcgcctggaagagatcgccctgaccgacccgtacttcatcgagcgctcgctgtacccgaacgtcgacttctactcggggatcatcctcaaggccatcggcattccgaccagcatgttcaccgtgatcttcgccctggcgcgtaccgtcggctggatctcgcactggaaagaaatgctctccagcccttacaagatcggccgtcctcgccagctgtacaccggctacgagtcgcgcgacatcaccaagctggaagaccgcaagtaagacctgttgccttgcgctaacgtcttgactgcagcggatacggcctctttatagaggccgtatttgtttgtgctcccctcccccgccatttccctgtagctgcctgcattcggccgcacagcggatgtggaatgccaactccacatcactctcacgctgaacgagcttgcgagcgctacgcactcgatcgcaggctgcgccagcggctacaaagggcgacgccaataaaaatgcccctgtctttcgataggggcactggtttgcaactcagcttatatatagaagccgatacacaggggccttagtgcgataccgcgccgctggctcccaggccggtctgcgagcgtacgaactgcgggaagaacagcgcccgctcattgtcagccgcagtggacttgtcggtgatggagaagaaccagatcccgataaaggcaatgatcatcgagaacagcgccgggtactcgtaagggaagatggctttttcatgccccatgatctgcacccagatggtcgggccgaggaccatcaggcccacggcactgaccaggcccagccagccgccaatcatggcgccgcgggtggtgagcttcttccagtacatggaaagcagcagtaccgggaagttgcaactcgccgcgatggagaacgccagaccgaccatgaacgcgatgttctggctctcgaacaggatgcccagggcaatcgccagtacacccaggcacacggtggtgatcttcgagacgcggatctcatccttctcgttggccttgcccttcttgatcacgctggcgtacaggtcatgggaaaccgccgaggccccggccagggtcaggccagctaccaccgccaggatagtggcgaaggccaccgccgagatgaagccgaggaacacgctgccgcccacggcattggccaggtgcaccgccgccatgttgttgccgccgagcagagcgcccgccgcgtccttgaacgccgggttggtgctgaccaaaaggatcgcgccaaaaccgatgatgaaggtcaggatgtagaagtagccgatgaagccggtggcatacagcacgctcttgcgcgcttccttggcgtcgctcacggtgaagaagcgcatcaggatgtgcggcaggccggcggtaccgaacatcagcgccaggcccagggagaacgccgagatcggatccttcaccaggccgcccgggctcatgatcgcttcacctttggggtgaaccttggtggcttcggagaacagcatgttgaagtcgaagttgacatgcttcatgaccatcaatgccatgaacgaggcaccggacagcagcaggaccgccttgatgatctgtacccaggtggtcgccagcatgccgccgaacagcacgtacagcaccatcaggatacccaccaggatcaccgccacatggtaatcgaggccgaacagcagctggatcagcttgccggcaccgaccatttgcgcgatcaggtagaacgccaccaccaccagcgagccgcaggccgacagcgagcggatctgggtctgcccgaggcgataggacgccacgtcggcgaaggtgtacttgcccaggttgcgcaggcgctcggcgatcaggaacagaatgatcggccagcccaccaggaagccgatcgaatagatcaggccatcgtagccggaggtgaacaccagggcggaaatccccaggaaggacgccgccgacatgtagtcaccggcaatcgccaggccgttctggaaaccggtgatcttgccccccgcggcatagtagtcggccgccgacttgttgcgcttggaggcccagtaggtaatgcacagggtggctccgacgaacagcacaaacatgatgatcgcagagacattgaggggttgtttatgcacttcgccggtcagggcgtcggccgcccagagacttggagcaaaggccgcgacgctaaaaaaagccaatagacgccggatcattgctgagcctccttgagaatcgcattgttcaggtcgtcgaattcgccattggcgcgtcgcacgtagataccggtcaggacaaaggccgcgacaatcaacccgacaccaatgggaatgccccaggtgatggatgattcagggctgagttttgcccccagtacatggggtccataggcaatcagcaggatgaagcccgaataaagcccgagcatgatcgccgacagtatccaggcgaatcgttcgcgcttgctgaccagctccttgaaacgcgagctgttttgaatcgagaggtaaatgctgtcgttcattgtttttatcctcgcagcacagattttagttggaaccgagggtctgttggcgcttggtgacgaccgcgacggcggcccagtgggtgcagggcaaggcacgaggaacgcagtttggttgttccaaataagttccgagtaacgccgccctgcgcccagtgggccccgtcccttcgggttgcgtgccaacttgcgcgaggctgcgttgcgggatttgccaagggaacaaccattggcggcatcccgcgccttgcctcgcacaagttggcccagcaacgcggttcgtcaccaagcgtcaacagaccctcagccactctatgcagctctggagctgattccagacgaccttagtattagaacgacagtacccctgacacgggcttttgcgccgggcaaaacaaaaggccgccgggtgcgaacacccggcggcctcgagacctgcgacctagacgcttcccggtcagttagcggtccattcggcgacgcgctcagggtgcttggccacccagtccttggccgccgcttccggcttggcgccttcttgaatcgccagcatcacctcgccgatttcatccttggaggcccactggaacttcttcagaaaggccgcaacctccggtgctttcttctccaggcctttactgccgatgctgttgacggtttcagcggcaccgtaaacacctttcggatcgtcgaggaagcgcagcttccacttggcgaacatccagtgcggcacccagccggtgaccgcgatggattcgttcttctcttcggcacgggtcagctcggcaatcattgccgcgcccgagctggcttgcagtttgtagtccagaccgtagtccttgatggcctggtcggtcttgagcatcacgcccgagccggcatcgataccgacgatcttgttcttgaaggtggtgtcacccttcagatcggcaatgctcttggccttgacgtactccggcacgatcaggccgattttcgcgtccttgaagttggggccgtagtcgaccaccttatccttgttcttggtccagtactcgccatgggtcaccggcagccaggccgacagcatggcgtccagcttgccggtggccacgccctgccacatgatcccggtcgccaccgcctgcaacttcacgtcataaccgagtttctgcttgatcacctcagacgctacataggtagtcgccacactgtccgaccaaccgtcgacatagccgatgctcagggttttgctgtcggcgctggccagggtagagctgatcgcaagtaccagaccggcacctgcgcccaagagtcgtcgcatcttcatcgttacttccccgaaagtgctgcgcccgacggatgccgagccgcgtcaacctgttgttatggtgcacagcgccctcatcacgccccaccaacttgctcgaacatcagcgcgattgccctatgagagccctgacgcgtcgatcatcaacctgacgccaaaggcgacctgctctgactgcgacctcaagacattcagcaacgacaccagttcgccagtaatcagggcatgcccaaaacagtcgcccaatcccgcccgaactttgcatgtcaaaatcatgcaggccacctgggcagcggcaaatccgggtaagatgcccggctttgtttcctgacggcctgaccatgccctcgattgcccgcttcccgctcctgccctatctattcgcctgcctgctgggagtcttcgcgctctgcggtttctggtacggcctcggccagccggtggtgctgccggatgtcgccagcgccagccataagctgcaatgcgcgtcctacaccccgttcgacaaggaccagtcgcccttcgaccagccgttcaaactgcgtccggagcgcatggacgccgacctggcgctgctggcgacccgcttcgagtgcatccgcacctactccatgaccggcctcgaagccctgccggacctggcgcgcaagcacggcctgaagctgatgatcggcgcctgggtcaacagcaacccggtggacaccgaaaaagaggtcgacctgctgatcgcctcggccaatgccaatccggacgtggtgagctcggtgatcgtcggcaacgaagccctgctgcgcaaagaagtcaccggcccgcaactggccaggctgatcaacaaggtcaaggctcacgtcaagcagccggtcacttacgcggacgtctgggagttctggctcaagcacccggaaatcgcgccggcagtggacttcctgaccatccacctgctgccctactgggaagacgatccgtccaacatcgatgccgcgctgaaccatgtggcgcaggtgcgccaggtgttcggcaacaagttcgcgcccaaggacgtgatgattggcgagaccggctggcccagcgaaggccgccagcgtgaaaccgctctgccgagccgggtcaacgaggccaagttcatccgtggttttgtggtcatggccgaacagaatggctggcattacaacctgatcgaagccttcgaccagccgtggaagcgcaccagcgaaggtgcggtcggcggttactgggggctgttcgatgccgatcgccaggacaagggcgtactcgccgggccggtgtcgaacctgccttactggccattgtggctgggcgtgggcggggtgatcttcgttgccacactgattctcggtggccgggtccgcggcactcgtgcggctctggtcctgcccctgcttggcgccctggccgcctgctccatcggcgcctggggcgagctggcgcgggtcaccagccgctttgccggggaatggttctgggcgggcctgctactggccctgaacctgctggtactggcccacgcggcactgagcctgagcacccgcgccggctggcgccagcacgctttcaacggcctggaaaaacgtgccggctggctgctcgccgccgccggtttcgccgccgcggtgatgatgctggagctggtgttcgacccgcgttatcgcagcttccccagcgccgccctgctcctgccggccctggtctacctgtgccgcccggtgcgagtgccgcgtcgcgaaatcgccctactgacctttatcgtcggcgccggcatcgccccccagctgtatcgcgaaggcctggaaaaccagcaggcctggggctgggccctggtcagcgtgctgatggtcgccgccctgtggcgcagcttgcgggctcgcaaagcctgacagaaaaaagggatgaccatggtcatcccttttttattaccggcgattcgcctcacgccaccgcgcgaggcgcccttaccagtcgcaaggcaccgatcacgatggcaaacaccgccaggctggtgttgtagagcgccagcgccgggaagccgaacagcagcgccagcaccgccaggccccagccggaacggcccggcaccacgaaggcgatcagggacgccgccagcgccgcccagcccatgaccttgaagtggatcagcaaccccaggctggaacgcgcctggcactcccagcggctggcctcgtcgacacagacgccgacccatcgagcgtcctccatgaagccgtagcgcacgccataactggcggccagccacaacggcaggacaacaagcagcagaatcaggggaagacggcgggacatgaagcactccgataagcgaaaacggcgcccagcataatcgcccgaggccggtaagcaagcttgttacatagataactgttgagcaaacagcggcaaagtgtatcgtctggcaactattaccgccgatccggctttgccctgccttgatcgttttttgtgccgagccatggcacttcggcagcaacccggtggtcatagcctgcgaacttcacccggcaccttcctctacagggatttagtcatgctccgttccttgcgcttcgctgccctgtttggcggccttatttcgagtgcgtccgcgctcgcggtcgacatcgatgccgccagctatggctaccccttgaccaatccgttcgaggcgaccattgccaccactccaccggacctgcgtccgaagctgccgagtaacgacgacatcaatcaggcggaccgcagcctgaccttgcgccccgagcgcgagttcatcctgccggacaacttctgggccgtgaagaagctcacctaccgcatcgccgagcaggaccatgccgcgccgctgatcttcctcatcgccggcaccggcgcgcgctatgacagcagcctcaacgagtacctgaagaagctctattaccaggccggctaccatgtggtgcagctgtcctcgcccaccagcttcgacttcatcagcgccgcctcgcggttcgccacccccggcgtgaccaaggaagatgccgaagacctataccgcgtgatgcaggcggtgcgcgcgcagaacccgaaactgccggtcaccgacttctacctcaccggctacagcctcggtgccctgaatgcggccttcgtcagcaagctggacgaaacccgacgcagcttcaacttcaagaaagtcctgctgctcaacccgccggtcaacctctatacctccatcaccaacctcgacaagctggtgcagaccgaggtcaagggcatcaataacaccaccaccttctacgagctggtactgaacaagttgacccgctacttccagcagaagggctacatcgacctcaacgatgccctgctctacgacttccagcagtccaagcagcacctgagcaacgagcagatggcgatgctgatcggcacctcgttccgcttctccgccgccgacatcgcgttcacctcggacctgatcaatcgccgcggcctgatcaccccgcccaagtacccgatcagcgaaggcaccaacctcacgccgttcctcaagcgcgccctgcaatgcgacttcgactgctacctcaccgagcaggtgattccgatgtggcgcgcccgcaccgacggcggcagcgtgctgcaactgatcgaccaggtgagcctgtacgcactcaaggattacctgcaggacagcccgaaaatcgccgtgatgcacaacgccgacgacgtgatcctcggcccgggcgacctggggttcctgcgcaagacctttggcgaccggctgacggtctacccccatggcggccattgcggcaacctcaactaccgcgtcaacagcgacgccatgctggagttcttccgtggctaaacatctcctgctcatcgctgcgttgttctgcgcaggctatgccaatgccgacgacggccagaccgcgacacccgtggtcgcggacggggacggcttcacccaaccgctcaagcggctcaagttcaacccaggcctggaccaacgcgagttcgagcgctcaagcctcaatgcgttgaacgtctacgacccgctggaatcgtggaaccgtcgggtgtaccacttcaactaccgcttcgatcagtgggtgttcctgccggtggtcgacggttatcgctacatcaccccgagcttcctgcgcaccggtgtgagcaacttcttcaacaacctgggcgacgtgccgaacctggtcaacagcctgctgcaattcaagggccagcgctcgctgaacaccaccgcccgcctgctggtcaacaccaccctcggtatcggcggtctctgggaccccgccacccgcatgggcctgccacgccagagcgaagacttcggccagaccctgggcttctacggcgtgccgggcggcgcctatttcgtcctgccgatactcgggccctcgaaccttcgcgataccgccggattggccgtggattacaccaccgaatcagcgatcaacttcctcaacgtgtccgaggtcagctcgaatcacccggaactctgggtcctgcgcgctatcgacaagcgctatcaaaccggcttccgctacggccagctggactcgccgttcgaatacgagaaagtccgctacgtctacaccgaatcgcgcaagctgcaaatcgccgagtgattcctccagggccctgccatccgcgcagggcccttttcttcgcccctcctctcaccacctgtaccttctccggccccggaaaaatcctcattggaatttcccaggcaagtagatacgatgctaatcattagccagctatctatgtgccttgccaatgaaaagcctcgccctgcgaatccccgatttctggttggccgtcctggctcccagccgcaatgacctgctgttcgccatcaggaacatgatcgccggggtcatcgccttgtacctggcctttcgcttcaacctcgagcagccgcaatgggccctgaccacggtattcatcgtcagccagcccagcagcggcatggtcctggccaaaggtgccttccgcctgctcggcacctttagcggggccgtggcctcgatcgtgctgatcggcctgttcggccaggcgcccctgctgtttctgctggcgatggcgctgtggctggccttctgcaccaccggtgcctcgctgctgcgcaatcatgcctcctacggcttcgtactggccggctacaccgcggcgatcgtcgccctgcccgccaccgcacatccactgctggtgttcgaccaggccgtggcccgctgttcggaaatcagcctggggatcatctgcgcggcgatcgccagcaccgtgctctggccgcgccgggtcgaacaggcgctggccacccagggcaagctcgcgtggcaagccggcatgcgcgccgcggcctccgaactgatcggccaggaccagcgcaaggggttgctggaagccctcggcaagctggtggcggtcgatgcccagcgcgatcacgcctggttcgaaggccctcagggccgtcgacgttcccaagctctgcgcgtcctcagccgcgacttgctgagcctgctgcgtgcggcccgtggcgtggcccgccagcggctgatgctcgacagcacggcgaatgccagcgtggctcccctgatcgaacagctggccacggtcctggagcacagccacgagcaagacatcgcccaactgtcggcaagccttcaagaggcgctgcaggaccgcagcctgtcacaggacgcgcatctgtgcctgatgcaactggcacaagtgccggtgctgctcgaacgcagtgcgcaaaccctgcaggccgtcgagcaagcccgagtgccccatggcgcgcctggcgccctgtcctggcaccgtgatatcgagcaaggcatccttggcggcctgcgcagcgccctggcatttctcgccgtggccggcttctgggtactctcggcctggccctcaggcctgggcgcggtatcgatctgcggggtggtgctgagcctgttcgccggccgggaaaacccttccgcctccagcctcaactttctcaagggcatcgccctgtcggtgccggtcgccggtttcgtcggcctgggattgctgcctagctgggacggtttcccgttgctgtgcgtgggcctgggggtgccgctgttttgcgcctcgctgtgcatgagcaagccgcggatggcgccgatcgcctcggcgttctgcatctttttcatcaacaacgtcggccccggcaacctgatgacctacgacctggccaacttcctcaacaaggccatggccaccctggttggcgtcggcatcgcggtcctggtgttccgcctggtcagccttaaccccggcgaacatcactatcggcggatgttccgcgcctcgctgttcgacctggcgcaactcacctcgcgcccgctggagcaagccgagagctggttcggcgggcgcatggccgatcgcttgatccgcctggcgcgctactccgaaagcctaccccaggaacgccgccagcactgggacaacggcctgctcgggctcgacctgggcgacgaactgctgcaactgcgcgccagcctgggtgcggcgaccggcgccctggccgtggaacgcgggcactacctgcaaagcatcgccacgctgctcaagtcaggcggaccgacgccacgccgtagcgatcgactggacgccccgaccgtcgccctgctcaaggccctggaacaggcgccgcaactgccggaacaggatctggaaatggccagggcggcgctgctgcaactgcaattcacctggcacaaatggtgccgcctgactcgccatgaacccggcgtggcggctgtcgcccaggggtaatgagcgggcaaaaaaaaccgccacgcgccggtggcggcgggtggcggcataacgccctgcgagagcccctcaggcttgcagcagcgggaacagcgaaatcaccagcagcaacgccatgccgtaattgaacaggcgtagccagcgcggatcgcgcaggacattgcgcaggacgctgccgaacccggcccagaccccgacgctcggcgcgttgatcaaggcaaacaggctggcgatcaccaccacgttgaaaaagtaaccctgcaacggcgtgtaggtgctgatggcccccagcgccatgacccaggccttggggttgacccactggaacgccgcggcgccccagaaccccagcggccggcccttgccgtcgacttcctgggacaccggcccggaacgggcgatgttccaggccaggtacagcagataggccgcaccgacgtagcgcagcaccttgtacagcaccgggtaggcctcgaacaccgcgcccaggcccaggcccacggccagcaccagcaccaggaaccccgaactgatcccgaggatatgcggcaccgtgcggcggaatccgaaattcacgcccgaggccagcagcatggtgttgttcggcccgggggttaccgaggtgacaaaggcaaacaaggcgaaagccaacaacaagtcgatcgacaacggcatacagtcatcctgagaagtacatgctccgaacagagccctgagtcattgttttcgccccggcgatcgccacggacgaggcttatccacgcttacagcaaagacccgatgaagcccgcggcgaccatcgcgtagaacgcgccgcagaccaggccgaaagccttgcgcgtgcggacgaaaaacggctccgccgaacgcgcggaaaaggccagggcataggcgcagaaaatcacgaaaccggcgaccgcacagctgcccaccagcacgaagctggcccaggatggcgccgtggcgctgaggccgacggtggtcacggtgaaccaggtcagggccgccttggggttggtcaggtggatgcccagcccttgcaggtagaaccccagcgtgcggctctgtttggcccgggcgcggttgaggttgaccgcactcgagctcagggcaccacggatggatttgtaggccagccataacagatagcaggcgccgaggatcttcagccagaccagcacctgggtgttggacatcagcaaggccgagacgcccgcggccgtcatcgcgccccagcacaacgaaccggaaatgaccccggccgccagcgccagccccggggtacgcccgtagctgagcgaggtgttggcaatcgccaggttacccgggccagggctggcggttccgatgacataaacggccatagcagcaccaaagctcgataaatcaaacatttgacggtctctcgtagaagtcgcgggagcagggtttaccaaccgggatgccgccccgcgcgggccggcatccctcctcgctacttgaagcagcgatgatcgggttcttcggcccggatcttttccatccagggtttgagttcggattgcttgtacagccgctcgccccagcgctcgggcgacaccggcagcggacgaccttgcaggatgtagtcagtcaacaggtggatgaactgctgcaggcaataggcgccgacatgcaggcgcagcgaagacgcggtttccgccggggcgatgttgaaacgcgcgacatggatgatgtcgccgctgtccaccgagggtgccaggtgatggcaggtcgaaccgtaggtttcgtcctggtagtagatcgcgtaatgctggctgcccaggccgcggtacttgggcggcgccggatgcaggttgatcgcgcccttgcgggcccgctgatagatgctcggcggaaagatgaagtcgccacgataggaaatgatccagtcgccttcccagtcttccaggtgatacggataggggtcgcccgggtcccaacagaacacttccaggttggaaaaaaccgtcttggcgaattcaacgccgtgatcgcaccagtccatggtgcacaccgacaatagaactttgtccttgcatggttcgatggtctgcatagtcttttccactattggctgttggtacatttcgaaaacacccccggtccgccctcccgctaaccctgctggcaggcctcgaccaccgccgtgaagcgttcgaccatttcggcgatttccgcttcgctggagatgaacggcggtgcgaacagcacgtggttaccgtgaacaccgtcggcggttccgctgcccggataaatcagcagcccttgttccagcgcctgcgccttgaggctcgcggcgtaacggccgccaccgcgatagggctcgcgggtgtcgcggtcctgaacgaactccacgccgacgaacagcccgcgcccgcgcacatcgccgacatgctcgaagcgcgccaggcactcgcgcaggccgtggcgcagttgctcgccgcgcaggcgcacggcctgcagcaggttctcgtcctcgatgacccgctgcacctccagcgcaacggcgcaggccagcggatggttgacgtgggtctggccgttgcccagcaccccggagttgcccgccatggcctcatgcacctggctgctgaccagcaacgccgagatcggctggtaaccggccgccaggcctttgccgaccgcgaccatgtccggcacgatgccgtcgtcttcgtaggcgaagaacctgccggtgcggcccatgccggccatcacctcgtcgaggatcaacagcacgtcgtggcgctcgcacaccgccttgatcttgcggaagtaacccggcaccggcggcaccgcgccgttggtggagccgaccacggtctcggcgaaaaacgccgcgaccctgtcgctgcccagcgcccggattttttcgtccagctccagcgccagccgcgtcccgtactgctcgtcgctttcatcggcgccctgatgacgataggcataacagggcgagacgaattcggcggccccgagcaacggctcgaagaccccgcgacgctgcaggttgccggatatcgacaaggtccccagggtgctgccgtggtagctctgctgccgcgagataaagatcgatttgcccggcagcccgcgctcgcactgatactggtaggcaattttcatcgccagctccatgacctcggagccgccggagagaaactgcgccttggccaacccgccggaggcccccaccagcaggtccgccaactcctcggcggcagccgtggtgaagcttccggcatgggcccaactgagcttttcgcctgctgctcgatggccgcggcgatccgtgggtgtccatgtcccaggctggaaacggccaccccgccgcacgtgtcgaggtagcgtttgcccgaggcatcctcaagccagaccccagcgccattgacggcgagaatcggtgaggcattcaagttcttgtagatgaccgttgacatggatccgagcccttgcagttatgcggcctaacgggtgttttccgggtggtcccacgccgtcgagccttgatggaaacgctggctgaagcgcgaggaattgaatatccggcgcgcccagccgatcggtagcaacaccacagcgaacatcaacaacgaaagcaacctgagcatggccttgtctcctgaataaaaagtgagtgagcgatcagtccagcgggatctcgttgcgccagtcgacctcttcgacgaactccggctgggtcgtgcgctcgagaatgaagttgcccagcaccagcacatccatctcggtgcgcatgaagcaggcgtaggcttcttccggcttgcacacgatcggctcgccgcgcacgttgaacgaggtgttgaccagcaccgagcagccggtgcgcttcttgaaactgcgcagcaaatgggtgaacggcgcgttgttttcttcggtcactgtctgcacccgtgccgacaggtcgacgtgggtcaccgccggcaactgcgaacggatcgaattgatgctgcccaggccacgctcaggaccacccggcttgcgcgattcctcggtcttgatcgagtcggtgacctgcgaaaccatcagcatgtaagggctcttctcgcagatgtcgaagtagacctgggcgtcctcgtccagcaccgccggggcaaagggccggaaggattcgcggtacttgatcttcaggttcatggtgcgctgcatctcgggattgcgcggatcgccgaggatcgagcgcgcgcccagagctcgcgggccgaactccatgcgtccctggaaccagccgaccacggcgccatcggccaggtgccgcgcggtttcgtcatacagctcggcaccctcgaagcgccggtacggatactggttggcgtcgagaaacgcctggatctcttcatcgccaaagcccggccccaacaggctgccgctcatggcgtcgagcttcttgctgcccaggtgcggacgcccggtgcgcttgaccgaatagtccatggccgcccccagggcacaaccggcgtcgccggccgcgggttgaatccagatcgcgtcgaaacgtccggaacggctgagcaccccgttggccacgcagttgagcgccacgccaccggccaggcacaggttgcggtaaccggtctggcgcacggccgcggtggccagccccagtaccacttcctcggtcacctgctgtaccgaggccgccaggtcgcattcgcgctgggtgatcgggctctccggcttgcgcaccggaccgccgaacaactcctcgaacgcctcgccgaccatgcgctcgccacgcaggtactcgaagtacttcatgttcagggtgaaggagccgtcggcgcggatgttgatcagttccttgcggatcttgtcggcatagatcggtcggccgtagggtgccaggcccataagcttgtactcgccggagtcgaccttgaagccgcagtaataggtgaacgccgagtagaacaggccgaccgagtgcggataggaaatcgagttcatcaggtcgagcttggaaccgtcgcccttccagatcgtggtcgaatgccattcgccgatgccgtcgatgcacagcaccgccgcctgctcgaacggcgacgggaaaaacgccgccgcggcatgggaacggtggtgctgcgaggcgatggtgagcgggccggtaccacgtcccagctcctcaagcttctcgtcgatgaacttgagcacattgagcttccagcggatccattccggcatggtgctgatgaaggtgcgcgcgccgctgatgccgccactggcgaaggaggaaatcatccgcgagaacttttcctgcgggtcttcgtagtagaccaccgcggtcagctcatcgaggccgataccctcggcgtccaggcagtacttgatggcattggccggaaacgccgcgtcgtgccgcacccgcgtgaagcgctcttcctgggccgccgccaccggcaccccgtccttcaccaacgctgctgcgctgtcgtgatagaacgccgaaatccctaatacgtaagtagccatttaaacgctcatcctcatagcttcatgccaatccatggaaattccctgtgtctgtgcacagtccatcatccgtgcaaccaacttgagaccggcaggctttttaatgccggaatcaacgacaccaccaacaacacactcattgaaatattgaacagacgcagccggttcggcttgctgagaaagcgccgcaaataacgtccgaacagcacccagaccatcgaacagggcgagccgaagagaaagaagatcaaggcgatcagcaggatctgcacactgtaggaaccgaccggcgtggtgtaggccaggaccgcgcccaccgccatgatccaggccttggggttgacccactggaacagcgcggcgccggtaaagcccagcgggcgcccgccctggtcgtcgagatcgactgtgggcgcggtggcgatacggtaggccaggtacagcatgtacagagcaccgaccacctgcagaatgtcgtgcagactgggataacgatggaataccgcgccggcgccgagccccaccgcgatcagcatcagtggaaagccgatgttgatgcccgcgacgtggcgcagggtgcggctgatgccgaagttgaccccggaggacatcagcatcacgttgttcggccccggcgtcacgcaggtggaaatcgcgaacaggatgacggcgtagtagtccagattctgcatgccccaggctccgctcaacgatagtcttcaagggtgccgcggcgacgaatgtcgaccgacacgcaatggaagccgccactgaggctgcgggcatggcgcattttcagcggcgccacatcgataccgtgtttttccagggcgcgaatcagcggcacctgctggtcgttgatcaccgccagggccgggttgaccatgatgaagttcatgccctgccagatcgatgcgcgcgggtaggaccagcaatagccggtgtcgaccatttccggcgcccagatgatgtcccagttcttgaatagcgccggcacctggtccttgcggatccgctccgggcacagcaccaccagccccgggcggaccacggtgatggtggtatccaggtgcgtgccgtcgtacacgccgctcaccgggtgcacccggtaacgctcgcccagcacccgctgcaaccactggcagcccagttcgttgccgctgcgggaaaccagatagaggatgtcctcgccgatgcggatcacgttggcggcgtcgaagatcggctcgtcattggcaatgatcgagccgtccttggggttgatccggtaggtgctgtccagcagctgcggcttgggcgcggagatccagttggagccgctggcaaagtattcggccaggtggcgacgataggcgaaaggctccaggtaacggctgcgcagcgccatcggcgcctcgatgatggtctggccgatgggcagcagcacatcccgcgggcagtaattgtattcgccgtcggttttccaggctggggtgccgaataccgcgcgatgatcagtgacgtccggccgccgcacaatgaccccgtgggaacgcagaaaggcggcaaaggcgtccaggtcctcgctggcctcctcgatgacctgctgcggataggggccggatggaatctcctcgatgtaatcgtgctgctcgctgtaatccagggcgaacagcccgcgatcaggtcgcggcacctgtgcgccctgggcgacgccgacgatcatctcttccagcggatcccactcgttgtgcacattgaccagagacataaacactccttgatgttcaggccgttacgcccagcggcgcggcagggacaataggttcgtgatggaacagcgcctgatcctcgccccgcgtcttgctccggggcagcaccgcacccgcggagccgatacccaggcgttgcaaccaggacgtcaggcggtccggctgcggtgccagggactcgtagccgacgcggacccgctgccagtgctctgccagttccgccggcttcgaggcggcgacctggcgcatgtaggcgtcgatggcgtccaccgcccaggccgaatgcccggtggagacgttatcgatggtgttgtgcaggtcgacgaacgcggtgctgaagccgtagtgcctgaggaagcgccgggccgagcgatagctgccgcccacccccgacagctccatcgccaggttcatgccgaggatttccggcatgaaggtcaccggcaacttgcccaggcacagccagtagaccggcaagcggaacgacgcctcgcgcagccgctcatcctcggcgaactcgcgggcaccggtgggcgccagctccaggcccatctggcgcaggccgtcgcggtagattttcggatggttcaacgcataggagccgttacccagctcatcccaataggtctggaacagcgcgtaaccgacatgggacgaggccagcgtcaggtcggtgaaaccctggagccaggcgccgtcgatcagggtcagcggtgccagttgcagggtggagtcgacgatttcttcgcgcgagggcatggccgccgggtcactttcttcgaactcctggccgtggcggtcgtgcttgtccagcaaccattcgcgcaagacgccgacattccaggcttcaggcaaagtgcgttcggagctttgcagcgagcgccgcgactgttccagccaacgggtcacataagcctgggcaaaagcctgggtgcgcggcgccagcgccctgccctgcaagacgaaataggcctcgcgcaagctcttgggccactggccctgctcttgaatatcctcgcccagcacctgccgaaccactgcattgcaaggggttggcgctggtgcttcggcagcttccgcacgctggatcgggccggacaggccatcgatccacttgcggatgacgctcaggtcggcctcgctgaaaatccggaacatgcgcccgttcggcgcgaccagggtattgaccagcaggctcttctcagcattgcccggcacgatcaggcggctgcgcgaaagcatttccagcagcggcacggggtcgacctgggcctcacgcagccactgcgccaggctgcggccttccatcttgtaatcctggtgatagaccgcgccggcccgggccatgcgctggatcatcttgcccatcaggcgctcgggcgataccgcggcccggcagtgcgccagcaatcgttcgttgaaggttttcagggccgcgaacaaccattgggcgcccgcctccaattgcaggcggcgaaggctgccctggctggcgacctgctcgcagacccactgggagatttccagcgccgaactgtcgtccgcgctttcatccagctggttcagatcgagccggcggacgtccagctgctgcgcatccagcacggaccaccatgggctcagccccagggcacgccaggcataatcgatgccgcacagggtgtcgccaaaggcatcgctgcggcggctgaccgcttgcagtcaggcaggtcggggagcgtggaaagttcgaacggcgaaaccgcataggcggtcagccccgactgtaccaacagcgatttgaagtgatcggcgcgcgatgccaggggccgcccgacgcccacgtcgtgggccagcaactccatgagcctgagctgcgcgctgtcctcgaagaccccgggggcgctcatgccttgcaaccagcagcccagcaccgaggccaatggcgccgagtgcgccagcagggcctcggcgaattcccgttggttgcccagttccgcggcctggctggccagttcgcggtaaacccgggcctgctcgtcacgccagagctcgatctgcacccgcaccccggacagaccttccgcaccggtttcccccggtgcggccaggcccatcaggcgccgaatactgacatcccccagaaagctctcgggattgctgactgatcgataaaactggcgccacatactgtttacttcccttccaggttggagaccaaggcaatccattgccggccctcagtcatcggcaagcaatgacgtcgggtgtcgagatcagaacatcgggtagatcgacgagtccggcttcttctttttcttcttgccgaacagacgttggaacaagctcttgatgtaactcatggcagactcctttaaagaacatcgaggatgattttcgagacgaaatcgttcccctggtcggtgaagtgaatacggtcgacgaacaaccactgttcaggccgcagggcctcggacagcagcggtgtaatgttcacgaaacgcacgcccatcttctgtgcgccttcgcgcaggcgggcggcataggcctcgcagacgctgggctgcaggatgtcgccatagacctcgctgaaactgccggcgcgatccagctcggcgaacagctgttcttcctcgtcgcagcccttttcccggacccagccggccagcggctgcagaatgaaggtcagcttggcgcccatgtcggccgccagtgcgcgccaggtatccaggtgacgcagggtcaggtcggcggcgtagtcgatctgctcttccatggtcggtggcggctcgggcgtcggctcttcctgttccttgccgagcaaggcgcggaacatgccgcgcttgggggcctgagtctccggacgcatggcgtcgaagaactgattgcagttgaagaaagcaccgtgttcgccacggctgctgtgtggctggcgggccagccccaggttgttgaacccggaaaacagcacgatctcgtcgaccttgggcagcaaatgacgataaagggtgaaaagcgtcagttcctgggtcgagttgaagctgcgtccgccgaagttgatccagggtttgctatccggatcgttctcggccaggcgcgaaggcagtgtccaggcatccgagctggcaccgatgccaaacacggtcgagctgccggccagcacccgcacgctcttggcgtgacggctgttgaccaccgaatactgtatgcccagcaactccgaatagcggaagcccgaggcatctgtattgaccacctccgaacggtggtcggtaggatggaagtacatcaaataaggcagccagcgaacctcaccaccgtcggtgaatttctgctcgtactcagccatctgcggagtcagtttgatccttgccgtcattaccctgctcttccttgagaagtcatcgtctaaagtagcctgagggggaagcccgttacacgttgcccggggggactctgaattgcgccgcaactgtatttaagaacaaccagtacagtgcgatgcgggccatcttcccaaaggcaaccactgtcttataggtacacgacggatgatttttctcagtacagattgccttttcgccctgaaaaattttcaaaaaaagtgaaatctgtaactttttatacgacagatgagtcgctacagtcccccgcatgactcgatacctgaatctcgccgaatacatcagcagccgcattgagcaggggttatacgggccgggggagcgtctgccttcggtgcgggccctgagcctcgagcacggcgtcagcctcaccaccgtgcaacaggcctatcgggttctggaaagctcggggctggctatccccaagcccaagtcgggctatttcgtcccggccggccggcgcttgccggagctgccgaagatgggacggccgtcgttgcggcctgtggatatttcccagtgggacctggtgcaggagctgatgcgccaggagcagaacgccaatgccattcaactgggttgcggcatgcccgataccacggcgccgaccctcaagccgctgctgaccgccctggcgcggatcagtcggcgcagcgatagccctagcctgcaatacaaccatctgcaaggtgtgctgagcctgcgcgagcagattgcccgcctcggcgtcgactccggttgccgcctgacgcccgcggaaatcgtcgtcaccagcggctgccaggaagccctgtccatcgccatccgcgccctgtgcgaacccggcgacatcgtggccatcgcctccccctgcttccacggcatcatccagctgctcaaggccgccggcctcaaggccctggagattcccaccgacccggtcaccggcatcagcctggaggccatggaaatggccctggaacaatggccgatcaaggccatccagctcacgcccaattgcaacaacccgctgggctacatcatgccggacgaccgcaagcgcgcgatgatccgcctggcccagcgctatgacgtgccgatcatcgaagacgatatctatggcgacctggcgttccgctacccgcggccgcgcaccctgaagtcattcgatgacgacgggcgcgtgctgctgtgcagttcgttctcgaaaaaccctggcgccaggactgaggatcggctggatcgccccggggcgttacctgccgcaagtgctgcacatgaaatacgtcggctccggcaccaccgcgacccagccgcagctggcggtggccgaattcattgccaagggtcactacctgccgcacctgcggcggatgcgcaaacagtaccagcgccatcgcgacctgatgaccgagtgggtcagccgctatctgccggaaggcacccgggtcagcaaaccccagggcgggttcaccttgtgggtggagctgccggacgagttcgacacctacaccctgaaccggctgctggaagccgaggacatccagatcgccaacggcaatatcttttccgcggccggcaagtaccgcaattgcctcaggctgaactttgccggcgtgcccaaccgcaagatcgaacaggcgatcatcaagatcggcctggcggtcgcgcaactgctccccgcctgacccccctcgcgcctgcccctcgccgccgtggcgaggggcatcagcgaatcaggccctggccgcgcgccacagcttgccgcccagcgacaccacgaccagtaccgcggcgccagcgatgatgccggccacggcattgagcagcgtcggcatgatcagcgaaaacccgccaaccgcctcggccgtgtgtgcggtgacagtctcgatccagtgatgcgccgccggcacgccatgggtcaggatgccgccgccgaccatgaacatggccgcggtgccgatcaccgaaaggcttttcatcatgtagggcgccgcgcgcaggatcgcgccaccgatgcttttcgccacctggcccggcttctgcgtcagccacaggccaaggtcgtcgagcttgacgatgccgcccaccaggccatacacaccgacggtcatgacgatggcgatgcccgaaagcaccaccacctgctgcatcaacggcgcgtcggcgacggtgcccagggtaatggcgatgatctcggccgagagaatgaagtcggtgcggatcgcgcccttgatcttggtcttctcgaaggccaccagatcggtggccgggtccgccacggcctcgatcagttgctggtgctcggcctgatcctcggccttgctgtggagaaacttgtgggcgagtttttcaaagccctcgaagcacagataggcaccgccgagcatcagcaacggcgtcaccagccagggtgcgaacgcgctgatggccagcgccgcgggcaccaggatcagcttgttcaggaacgagcccttggccactgcccagaccaccggcaactcacgctcggcgcgcaccccggagacctgctgggcattgagcgcgaggtcgtcccccagcaccccggcggtcttcttcgccgccattttggtcatcagtgccacgtcgtcgagtaccgcggcaatatcgtcgatcagcaccagcaaactgcttccggccatggatcagggttccttgaggtcataaatgttgcgaagcataacgcgcaacgagggcccgcggggcattcttgagcctcgcgcaaggccggtgctaccatgcgcaaccgcccgaacaggcaaggaatcacctggtttatgagcaccatccgcgagcgcaacaaagaactgatcctgcgtgccgccagtgaagagtttgccgacaaaggcttcgctgcgaccaaaaccagcgatatcgcggccaaggcaggattgcccaaacccaacgtctactactacttcaaatccaaggaaaacctctaccgcgaggtcctggaaagcatcatcgagccgatcctccaggcttcgaccccgttcaacgccgacggcgtgcccagtgaagtgctgagcggctacatccgctcgaagatccgcatctcccgcgacctgcccttcgcctccaaggtgttcgccagcgagatcatgcacggcgctccgcacctgagcccggaccaggtcgagcagctcaacgcccaggccaagcacaatatcgattgcatccagacctggatcgatcgtggccagatcgcgcccatcgacccgcaccacctgatgttcagcatctgggccgcgacccagacctatgccgacttcgactggcagatctcggtggtgaccggcaaggccaagctggacgagtccgattacgaagccgccgcccagaccatcatccgcctggtgctcaagggctgcgaaacggacaagtaagccagcccctgtagccgctgccgcaggctgcgataaggccgaaggccttcagcgatcttcagatcttgcgcacacgttgtgtgcgatcgcagcctgcggcagcggctacacggctacacggctacagatcaggcgctcacgcccgcatccgcctgcaagccctgcgcctcgatcgcgctgatcgcgcactgttcgtcgatgtccgaggtgtcgccgctgatgccgatcgcccccaccaccgccccctgctgatcacgaatcaacaccccacccggcgccggcaccacgctgccctgccccagactattgagcgcggcgataaaagccggccgctgctgtgcatccagcgccagcaggcgcgagcccttgcccagggcgatcgcgccccaggccttgccgatggcgatctgtggccgcagcaggctggccccgtcttcgcgctgcaaggtcaccagatgcccaccggcgtcgagtaccgcgatggtcaagggtgccgcgctgatctcgcggccgaaggccagggccttgccggccaggctgactgcaacgttcaaggttaaagcgctcatgggtgccgtccttattttgttattgggagaaatctgggtgttccgataagaagatcgatacaacaaatagaacacaacaaattttatttttgtatacaataatcttcgcaaatccctgcttccgacgaaaagctgcctgtttaccggcaccggacgaacgcaccccagcgctagagaaaatggattgacctgcgacgctcgccgtgaatacactctgcgcaaagccacttgtatacaattacaaaacgtaagaggcacaaaaccatgagcaaaatgagagcaatcgaagccgccgttctggtgatgcgccgtgaaggggtcgataccgcctttggcatcccgggtgccgccatcaacccgctgtactccgccctgcaaaaggtcggcggcatcgatcacgtcctcgctcgccacgtcgaaggcgcctcgcacatggccgagggttacacccgcaccaaggccggcaatatcggcgtgtgcatcggtacttccggccctgccggcaccgacatggtcaccggcctgtacagcgcctcggccgactcgatcccgattctctgcatcaccggccaggccccgcgggcccgcctgcacaaggaagacttccaggccgtcgacatcaccagcatcgtcaagccggtgaccaagtgggcgaccaccgtcctggaaccgggccaggtgccctacgccttccagaaagccttttatgaaatgcgctccggtcgccccggcccggtgctgatcgacctgccgttcgacgtgcagatggccgagatcgaattcgacatcgacgcctaccagccgctgccgctggccttgccgtcggcgacccgggtccaggtcgaaaaggccctggccctgctggatcaggccgagcgtccgttgctggtcgccggcggcggcatcatcaatgccgatgccagcgaactgctggtggagttcgccgagctgaccggcatcccggtcatcccgaccctgatgggctggggcagcatccccgacgatcacccgcagatggtcggcatggtcggcctgcagacctcccaccgctacggcaacgccaccctgctcaagtcggacctggtcctgggtatcggcaaccgctgggccaaccgccacaccggttcggtggacgtctacaccgagggtcgcaaattcatccacgtggacatcgagccgacccagatcggccgggtgttcaccccggacctgggtatcgtctccgacgccagttcggcgctgaccgtgttcatcgaagtcgctcgcgaatggcaggccgccggcaaactgaagaaccgcaatgcctggctgcaggattgccagcaacgcaaatcgagcctgcaacgcaagacccacttcgacaatgtgccggtcaagccgcagcgcgtgtatgaagagatgaaccaggtattcggcaaggacacctgctacgtcagcaccatcggcctgtcgcagattgccggcgcgcagttcctgcacgtgtacaagccacgccactggatcaactgcggccaggccggcccgctgggctggaccattccggcggcgctgggggtggtcaaggccgacccgagccgcaaggtggtggcgctgtccggcgactacgacttccagttcatgatcgaagagctggccgtgggcgcgcagttcaagctgccgtacatccacgtggtggtgaacaactcctacctgggcctgatccgccaggcacaacgcggtttcgacatggactactgcgtgcagctgtccttcgacaacctcaacgccccggaactcaacggctatggcgtggaccacatcgcggtcgccgagggcctgggctgcaaggcgctgcgggtgttcgagccgtcgggcatccagccggccctgcgccaggcccaggaaatgctccagcagttcaaggtgccggtgatcgtcgagatcatcctggagcgtgtcaccaacatctccatgggcaccgagatcaacgcggtcaacgaattcgaagacctggcgctggtcggcaacgacgccccgaccgcgatttccctgctcgactgacccccctatgtagccgctgccgaaggctgcgatcgcatccgcgggatgcgcaagatctcaggatcgtcgaaggccttcggccttatcgcagcctgcggcagcggctacagagcccccttttcacaggagaccaccatgccgcgttttgccgccaacctgtccatgctgttcaccgaacaggacttcctcgcccgcttcaaggccgccgccgaggctggcttcagtggtgtcgaatacctgttcccctacgaattcagctccgccgaaatcaaggcgcaactcgacgcccacggcctgacccaagtgctgttcaacctgcctgcgggcgattgggtgaaaggcgagcgcggtatcgcctgcctgccggaccggatcgaagagttccgcgccggggtcgacctggccatcgcctacgcccaggtgctgggcaacacccagatcaactgcctggccggcattcgtccgcaaggtttcgacgatgccacggtggaaaagaccttcgtcgccaacctcaagtacgccgccgaaaaactccaggccgcgggcatcaagctggtgatggaagcgatcaacacccgcgacatcccgggcttctacctgaacaacacggcccaggccctgtcgattcgcgaacaggtcggcagcagcaatctgtacctgcaatacgacatctaccacatgcaaatcatggagggcgatctggcccggaccctgtccgggcacctggacgcgatcaaccatgtccagctggcggacaacccggggcgtcacgaaccgggaaccggcgagatcaactaccgcttcctgttcgggcacctggacaagatcggctaccagggctgggtcggctgcgaatacaagccgctgaccaccaccgaggccggcctgggctggctcaagaaccacaacgcaatctgatcgggcaacgcgtcatcgttcatcgcggtaggagcgagcttgctcgcgaagatcgtcaacgatgacgcaggcatcctgaatgaacacggcgcccttgccgtttttcgcgagcaagctcgctcctacagagggcgtgctacctaacaaaaagaggattttctcatggctaaaatcggattcatcggcaccggcatcatgggccacccaatggcctccaacctgcagaaagccggtcacagtctgttcctgtcccagcaccacgacgcggccccggccgacctggtcgccgccggcgcggtcgccctggccagccccagggaagtggcccaggaagccgaattcatcatcgtcatggtcccggataccccgcaggtcgacgacgtgctgttccgcgccgacggcgtggccgcgggcgtcggcccgggcaaggtggtgatcgacatgagctcgatctcgccgaccgcgaccaaggccttcgccgccaggatcaacgagaaaggcgcgcagtacctggacgccccggtgtccggcggtgaagtcggcgccaaggcggcgaccctgagcatcatggtcggcggcgacagccaggccttcgagcgcgccctgccgctgttccaggccatgggcaagaacatcaccctggtcggcggcaacggcgacggccagaccgccaaggtggcgaaccagatcatcgtcgccctgaacatccaggcggtggccgaggccctactgttcgccgcgaaaaacggcgccgatccggccaaggtgcgcgaggcgctgatgggcggcttcgcttcctcgaagatcctcgaggtgcatggcgagcgcatgatcaagggcaccttcgacccgggcttccgtatcagcctgcaccagaaggacctgaacctggccctgcaaggcgccaaggagctgaacatcaacctgcccaacaccgccaacgcccagcaagtgttcagcacctgcgcagccatcggcggcagcaactgggaccactcggcgctgatcaagggcctggaacacatggccaacttctcgatccgcgaccagtaagagaacgccaggaaatcccctgtagccgctgccgaaggctgcgatcgcctgcgcagcaggcgtgcacttgcacatcgcaggaaggttcttcgaaccttatcgcagcctgcggcagcggctacaggttgcgttacagccacacctcgaataacaagaaatccgggagcccgccatgtcggtcgatccgcaacaattcctccgtgagctgttcgccacagccatcgacgccgcccatccgcagcacgtcctcgcagcccatttgcccagcgaccgcagcggtcgggtgatcgtcatcggtgccggcaaggccgccgcagccatggcccaggtggtcgaacgctgctggttgggtgaagtcagcgggctggtcgtcacccgctacggccacggcgccccctgcgaaaaaatcgaagtggtcgaagccgcccatccggtgcccgatgccgccggcctggccgtggccaagcgcgtgctggaactggtcagcgacctgtcagaacaggaccgggtgatcttcctcctgtccggcggcggttccgcgctgctggccctgcccgccgcgggcatcagcctggcggacaagcagtcgatcaacaaagccctgctcaagtccggcgccaccatcggcgagatgaactgcgtgcgcaaacacctctcggcgatcaagggcggccgcctggccaaggcctgctggccggccaccgtctacacctacgcgatttccgatgtaccgggcgacctggccacggtcatcgcttccggccccaccgtggccgaccccagcacctcggccgaggccctggcgatcctcaagcgctatgccatcgaggtcccggcggcggtgcgcacctggctgcaaagcccggagtcggaaaccgtcaagcccggcgacccgagcctggcccgcagtcacttccagctgatcgcccggccgcagcagtcgctggaggccgccgcggtgaaagcccgccaggccggtttcagcccgctgatcctcggcgacctggaaggcgaggcccgcgaggtggccaaggtccacgctggcatcgcccgccaggtggtgctgcatggccagccgctggcggcgccttgcgtgatcctctccggcggcgaaaccacggtcaccgtgcgcggcaatggccgcggcgggcgcaatgccgagttcctcctgagcctcaccgagagcctcaagggcctgcccggcgtctacgccctggcgggcgataccgacggtatcgacggctccgaagacaacgctggcgcgatcatggccccggacagccatgcccgcgccgccgccctgggcctgagtgccagcgacgagttggacaacaacaacggctatggctatttcgcggccctggatgggttgatcgtcaccgagccgacccgcaccaacgtcaatgacttccgcgccatcctgatcctcgagagcccccaacatgacgcctgacaaaaaggtcaaaatcctcgccaccctcggcccggccatcgacggcatcgacgatatccgcgagctggtgcaggccggggtgaatatttttcgcctcaacttcagccacggtgaccacgccgatcacgcccagcgttaccagtggatccgcgaagtcgaaaagcagctgaactacccgctgggcatcctgatggacctgcaaggcccgaaactgcgggtcggcaaattcgccgaaggcaaggtccagctgcaccgcggccaggccctgcgcctggacctggacagcaccccgggcgaccagcgccgggtcaacctgccccacccggaaatcctcaaagccctggagccgggcatggacctgctgctggacgatggcaagctgcgcctgcgggtcatcgccaaacacgccgacgccatcgacaccacggtactcaacggcggcgaactgtcggaccgcaagggcgtcaacgtcccgcaggcgctgctcgacctcagcccgctgaccgccaaggatcgccgcgacctggaattcggcctggaactgggggtggactgggtcgccctgtcgttcgtgcagcgccccgaggacattcgcgaagcccgcgcgctgatcggcgacaaagcgttcctgatggccaagatcgagaaaccctcggcggtcacccaactgcgcgagatcgccgaactgagcgacgcgatcatggtggcccgtggcgacctgggcgtcgaagtgccggccgaaagcgtgccgcagatccagaagaacatcatcggcacctgccgccagctgggtaaaccggtggtggtggccacgcagatgcttgaatccatgcgcttctcccccgccccgacccgggccgaggtcacggacgtggccaacgcggtggccgaaggcgccgacgcggtgatgctctcggcggaaaccgcctccggcgaatacccgctggaagcggtgcagatgatgagcaagatcatccgccaagtggaaagcggtccggactaccaggcccagctcgacgtcagccggccccaggccgaagccacggtgtccgatgccatcagctgcgcgatccgccgcattagcagcatcctgccggtggcggtgctggtgaactacagcgagtccggcagctccagcctgcgcgcggcccgggagcggccgacggtgccgatcctcaacctgacgccgaacctgtccaccgcgcggcgcctgacggtggcctggggcgtgcactcggtggtcaacgaccgcctgcgccaggtcgacgaggtctgctccactgccctggaaatcgcccaggcgcaaggcatggccaaacgtggcgacaccctgttgatcaccgccggcgtgccgttcggacagccgggctcgaccaactcgctgcgcatcgaaaccctgatctgagcctgtagccgctgccgagcctgcgaggctgcgctcgaaaacgcagtcttcgccaggcccgagcactggacttgcctgtggaacacggcattgcctgattgatggccgctacgcgcccgatcgcagcctcgctgtgctcggcagcggctacaagagcccaccttcatgccttcagaacacttcaacgcgcactgccccgactgggccaccgccctgctcaacggcttcagccaggtcttcctccagcgccatccgctgtgcggcctgctgtgcatgctggccatcctcctgagcgctccggcgttgctcggtggcgcgctgctgggcggcgtggccgggctgctcaccgcgcagcgccggggttatgccaaggccgaccggcaagccgggctgttcagctacaacggggtcctgctcggcctgctcctgagcctacgcttcgactggtcggtgctgctgccaccgctgatcatcgcctgcggcggcctcagtgcgatcctcacccggcaatggctcaaacgcgcccgcgacccatactgcctgccggcctacaccgcgcccttcgtcggcctcggctggttgctgctaggcctggccgcgccgctgcccgccagtgccgccgcgccctgggtcgagcccgatacgctggcgctgctgcaggcactgatccaggggctcggccaggtgatgttcctcgagcatccgctggccggggtattgatcgctctggggttgctgctggctgatcgccggacggccgcctgggcgctgttcggttcggcggcgggcctgggcttcgccctgctgcaacaggagcatgccgatgccctgtcaggccttggcggctacaactgtgccctggtcgccctggccctgagccaggaccgccgccgatcctggttggccctgccgggcatgctcctggcgctgctgctcgccccgggcttcgccgcgctgggcctacccgttctcaccgcgccctttatcctcgcctgctggctggtccgcgccgcgctgcgggtgctgcgccaggccgccgtggacagcacgccttgcgctaccggggccaatccccctaggcttcgctgaccttcgattcaggcgaacaacatggacagcaacacggacaacaaccggcactggcgcgagcgtctctacgtcatgattttccagaccgacaccgtggccggtcgacgcttcgacagcaccctgttgctgatcatcctcgccagcctggtgatcgtgatcctcgacagcatcgacgaggtgcatcagaactacgccaatgtgctggcctatatcgaatggggctttaccctgatcttcgccatcgaatacggcctgcgcctgtattgctcgcccaagccgttgcgctacgccttcagtttctacgggctggtggacctgctggccatcgtgccggggatcctcgccctgtattacagcgacgcccagtacctgctgatcatccgggtgatccgcatgctgcgcatcttccgcgtgctcaagctcagcccgtatctcaagcaggccaactacctgatgtcggcgctgcgcggcagcaagcagaaaatcatcgtgttcctgctcagcgtgtcgaccctggtcacggtgttcggcaccctgatgtatgtggtcgagggacccgagcacgggttcaccagcatccccaagggcatctactgggccatcgtcaccctgaccaccgtgggttttggcgacatagtgccgaagacgccgctgggccaggtgatttcatcgatggtaatgatcaccggttactcgatcatcgccgtgcccaccgggatcttcaccgcggaactggccaatgccatgcgcggcgaacagctcaagcacgactgcccggtgtgcagtaaaaacaaccatgaacacggcgccgcgttctgctcgcggtgtggcaacgcgctgttcccgaaagtggttcaggaaaactgaataagcaaagcaccttttaatctttaaagagatataccgccccggctatagtcggcggcaaattgccttcactctcgaattcactctcaacaaaaaggaatgtgcagtgaaaaaactcgttagcgcctctctcctggccgccggcctggcactgggcagcgtcgcccaggccgccccgaccctgctcaacgtttcctatgacgtgatgcgagacttctacaaggactacaacagcgccttccagaagcactggcaagccgagcacaacgagaacatcaccctgcagatgtccttcggcggttccagcaaacaggcgcgctcggtgatcgacggcctgccggccgacgtcatcaccatgaacatggccaccgacatcaacgccctggcggacaacggcaagctggtgccggacaactgggtgacccgcctgcccaacaacagcgcacccttcacctcggccaccgtgttcatcgtgcgcaagggcaaccccaaggccctgaaagactggccggacctgctcaaggatggcgtacaggtgatagtgccaaacccgaagacctcgggtaacggccgctacacctacctgtcggcctggggttatgtgctgaagaacggcggcgacgagaacaaggccaaggatttcgtcggcaagctgttcaagcaggcaccggtgctcgacaccggcggtcgcgccgccaccaccaccttcatgaccaaccagatcggcgacgtgctggtgaccttcgagaacgaagcggaaatgatcgcccgcgaattcggccgcgatcagttcgaagtcatctacccgagcgtctccgccgaagccgagccgccggtgtcggtggtggacaaggtggtcgacaagaaaggctcgcgcgccgcggccgaggaatacctgaagtacctgtggtcgccggaaggccaggaaatcgccgccaacaactacctgcgcccacgggacccgaaagtcctggccaagtacaccgaccgtttcccgaaagtcgacttcctgtcggtggaaaaaaccttcggcgactggcgtaccgtgcagaagacccacttcaacgatggcggggtcttcgaccagatctacggcggtaagtaacaacacctgtagccgctgccgcaggctgcgataaggccgaaggccttcagcgatcgtcagatcttgcgcacacgctgtgtgcgatcgcagccttcggcagcggctacagtattttgcgggtcaggaatctaaagcccggcggcagcttcgaacagcaccgccttccccgcctgatgcagctcaggcaacatcgcctcggcctcgatctcgatcagccactcgggcaaggacaggccactgacgatgatccacgaggacgccggtggctgctgggggaaacgctgcaacagcacctggctgatctgttcctgctggtcgcgggctgcttcggcgatgtagatccgcagcatgaccatgtggctcaggtcgccgcccgccgccgccaggacccgggcgatattgtcgaagctctgctcggtctgctcgcgcagccccgggccgacgcagacctcgcgctcatcgacacccacctggccggacagcagcaggcgccgcccaccgcgcacctccacggcctggctgaaaccgtactgcagggaattgaagacactgggcggattgaagactgatgcgtgcatgggacctccgctgcgatagacgaccgcaaaccctaaaccaagcccctgcacaaggccatccgaaacgaggtcgttgaaacacctggcaacgtaaccgccagccagctacatcggcggcgtcaccccatccttgccggcggagatcgattgcgcggtgagcgtgccgtcagcgctctgcgagacgaacatcaccaccttgaccccggccttgagcaggctgcggtcgcccggcaccaggttgacgatgggcacgtcgtccggcaccaggatcgtctgctggccgcccttgtagttgacggtcagggtccggccgttgctcaccaccaggtcgccgacgctgccattggtcatgctgctgcccttgaccagatcgaaaggccgatgaccgtcgccggtgccggccatctgcggtggaaacacatggacctccagcgccttgaggctgccatcggcctgcggcacggcggccgaacctatgtagctgccgggcttgatgtcctcgatattggccagggtcacggcgcggacctgggtctgtggcgtgaggttgatggtgacgttctcgccgctgttgacgtgcacccgcaccgcgtcgccggcgacgctggtgatttccccgcgcacgccgatgcgcatgcccggcgcgtcctgggcctgggccgggccggccagcagcagtgcgccgagggtgatcgcttgggcgccgccgagcaggcggcgaagacacagactcatgggacgggcttcctgtgatgaaaggtggcacagaggtctaaacgagagcactccagtgtccgcggaacaatgagcgagctatggaactggatgtaagtaaatgtatcatcgcaacgcgatcccggtcgtcgtctgccgctctcggccggcccgccaggcatttattcctcccgggcatgaatgctatcgctcgtcagcttctaccgcgtcacgggccagccccttagcctcgcccgcatccttttcgctgcaacgagaatcgccatgacttccacgacccaggggctgcccgccgccacgaccatgacccgcggcatggtgctgctgttcgccttctgctgcggcgccatagtcgccaacatctactatgcccagccgatcatcgagctgatcgccccggacatcggcctgagcagcaccatggccagcctgatcgtgtccctgacccagatcggctacgccctgggcctgttcttcctggtgcccctgggcgatctgctggaaaaccgccgactgatgatcctcaccagcctggtggccatcgccagcctgctgggcgccgggttcaccgagcagcccaacgcctttctgctggtctcgctgctgatcggcttcagctcggtgtcggtacagatcctgattcccctggccgcccacctgacgccggaggaatcccgcggccgggtggtcggcggcatcatgggcggcctgctgctgggcatcctgctggcgcgcccggtgtccagcgtggtggccgacctgttcggctggcgcgcgatgtttattgccgccgccgtgctgatggccgccatcagcctggtcctgctgctgaccgtgcccaagcgccagcctgcccacagcgccacctacggccagttgctgcgctcactggggaccctgctgcgccagcaaccggtgctgcgccagcgagcgttttaccaggcctgtatgttcgccaccttcagcctgttctggaccgcggtgccgctggagctggcgcgcaaccacggcctgtcgcaaagccagatcgccctgttcgccctggtcggagccatcggcgccatcgccgcgcccatcagcggacgcctggcggatgccggccacacccgcgtcgcctccttgctggccatgctgttcgccgccttgagcttcctgccggcctttgtccacccggcctacagcgtcatcggcctggcagtgaccggcgtggtcctggatttctgcgtgcagatgaacatggtcctcggccagcgcgcggtctacgccctcgatgcccacagccgcggccgtctgaacgcgctgtacatgaccagcatcttcatcggcggcgcggtcggttcgtcgattgccagcgcggtctacgaacacgccggctggctgggcatagtcggcgtcggcagcgccttgccgttgctggccctgctgcgtttcctgggcacctcgcagaaggcgctgcctgttacggcctgatgcattcccccagtcgcaaaaccggaggacaaggcaacgctccagaccctgctcgatcgttcacacacaaggagtcccaatggaccggctggcagccatgcaaaccttcgttcatgtggtggaaagcgggtccttttccgccgccgcccggcttctggatatcggccagccggccgtgtcgaaaaccatcgcccagctggaggcgcggctggcggtgcggctgttgctgcgctcgacccgcggcctgacgcccaccgaggccggcatggcgtttttcgagcgcgccaggcgggccctcgaagaggccgacgaagccgatctcgcggcgcgcggggccggtacggggctgcgcggtacgctgcggatctgcgccgcggtgaccttcgcccgcctgcacatcgtgccgcacctggggagctttctcgaacgccaccccgagctcgacatcgacgtggtgctggatgaccgcaatatcaatctggtggaggccggcatcgacgtcgccctgcgcatgggcccgttgagcgactccgggctgaccgcgcggcggatcggcgaatgccggcgcgtggtattggccaccccggactacttcgcccgccacggcgaacccgcctgccccgccgacctgggccagcaccaggcgatcgtctacagcctcggcggtggtgcccactggcgcttcgaacggggtgacgaacagcattcggtgacagtccgcgggcggattcgcgtcagcgccgcggaggggttgcgcgagtcggtgctggcccaccaggggctgaccctggcctcacaatggatgttcgcccccgagctgaccagtggcgcggtgcgcgaagtgatgtcggactggacgctaccccgccaggagctgtgggcggtgttccctaccggacggctgaccagcgccaaggcccgggccttcgtcgagtttgtccagcagctgctgacccgcgcggatgccactcaaggttgagcgacgtcagattcgcccacgtaccagcacttcgaccttggccgcctcgccccagcgttggacccgctcgatcagcgcagggtcggtttcgcccaccagatacaaggtttcgatcgattgggcagccgcccactcgacaaacccgcactgctcgaaggtgtcgatagccgccagctggaactcgttttcgtaaaagccgggcaccacggcaaccagggcatcgacggtactgacttcaggcaggaacggacaggccaggtgcaccacgtcccacttcgccacgcgccagttgtgcagcgcttcgtcgaagcggctgcgggcgccgcggacaaaccccaggccatcgatcaccatgcgccggttgatgatcatccataccttgcgtttgcgcggggccttgagcagcacctcaccggtgaccttcgaggcacgcagggccagggcgaacaccagcaataccggaacgaagtagcgataaacggtctcggcgttggtggcgcgggtcagctcatacagcctggaaacctcgccccgggccttgcgctggtcgcccagggtttcatcgaggcggccgagccacgccaatacaggcggcgccgaataccgggcgcgaagctcatccagtgcctggatcaccgtccccaccgagagcgccgtcagccgcccctgcgccgttctctctaacgtggcaaaacgctgacagagctcgttcacctgcgcggcatcggcggcgctatagagagtcgcggcggcacggcaatgatccgggcccagcagatcgtcgatctcggccttgaggcgcctctgggtcgaggcttcatggaattcggctagtcgatagtcgctctgaaaccattcggtcctgacgttctgcgtctcgctgatcagggccagcgaagccagcagcagccagccgtagtccacgcgcttccagccgatctcgcccaggggaaagaccgagatgaagctccagcagaagaagtagtagaggaagatgaacagcaccagcaaatacgccggtgccagggagaagtagatcagctgcggcacttggacatcggcgaagccatgcagggcgagcagcacagcgacaacacagagccagaaggccatgggcgcgaaatagggtttgttcaggcttttcttcatcgggcgctcggatggcgatactcaggaacaccccggggtatcggccatccaaccgaccgcttgaaccggactcgctcgcggtccgctcagtggtcgccgcttacggagagccgcttactggaactgacgccccaggcccgacggcacaccgtggatatcggtctcttcccatggcccgtcggggctgatggaacggctccaaccgttattccagcggtagtaggtgcgctggcggtagaaggtgttggtctggttatccagcacatagacacccaggcgcgggtcccagtggctgttgccgcccggtggcggcgcgaagctcgcggaagtgcgcggcaacggcttggccggcttgatcggcgtggcaggtttgctcggagtgccgggcgtcggcttggtagtgggttgcgcgggcggaatcggtggcaacgtctcgggcggcgtcggctgctggaccgcacaggcgctcaaccccaggaccagtgttaacagggtgatacgagcaatggcggtcatggcggcttctcttatttatccgggctgtcgatggtcagttgttgcggcgcggtggtgctgctggccaggggcttgctgcgaccgacccactcaccggcagtcggttggccggcgcgggaaatgcgtgcaaccagttggacttccgggaagttcgacagtttcaactgcggcatcatcgcgtcggcgtcccccagctccaccgtcaccggcaggtcggccacggtcaggcgcttggccgccagcggcgccggcggcccggaagtggcgcgggcaaagatgaacacgctgtcgcccggctgcaccttggctttcagatcggcggccagctcgacccgcaccttgagcagcgcagcagccttgggcgcaggtgcctgggccactttgccgccgctggccagcagcttctcggtggcccggtcgataccgccctgcagcgcggcgcgcgagttgtcgtccgccggcaattgctccagcaggcggttccagtagtcgatggcctcttgataacgctcgccttcgaaggcggcgatgcccagcaggccgagactggtgacttccttcggatcggtcttcagcgcttcgtcggtcagggcctggaccttgtccgaccaccgcttgccgtcggcgaaatactgcgcctgcgcccactggccgagcagttccggctggcgcccggccagggccacggtgcgctcgaagatcttcgccgcgtccgccgggcggtcctgggccatgtaggtacggccgaggaagtacaggccctcggcggaatccggctgggcggcgaccgcgcgctcgaggcggcgggtcatctcttccatggattgcggggcctgggcgaattcacgggtcagctcgaccttgtcgctggcaccgaaatgcaggtacaggcccaggcccaatagcggcaccagcagcgccgccagcaatggcagcggcttgcccagaccggacacccgggccggttccgcgccctcggtgtcggccagcagttcgcgcgcggcttcggcgcggccgctgtccatctgctcggcgctgagcacgccttcggcctgctggccttgcagctcggccacgcgttcttgataaagcaccacgttcagcgcggtacgatcctcttcacgctgggcgcgacggccgcgtagaaccgggatcagcagaaaactcagggctaccaggagcagcaggcctgcggcgagccagaaatcaatcattcgcggtctttatccaacagttggtcgaggcgctgacgctcctcggcggaaagtgtgctcgggctgtcgctgcgctgcacgcgccgacgccggacgatcacggcgatgatcaccacgccccccagcagcaggccggcggggccgaaccagagcaaggcggtcttgccggtcaaggccggcttgtagcgcacgaagtcgccatagcggtcgaccatgaagtcgatgatctgctggttgtccttgccttcgccgagcatgcggaagatctccttgcgcaagtccgcggcgatcggcgcattggagtcggcgatgtcctggttctggcacttggggcaccgcagctctttggtcaactcgcgaaagcgctcgcgctcggcgtcattggcgaattcgtaggtatcgatcgcggcgtgggctacgccagcgatgcagaggcccaggacggccgcggccagccagcgcttcatggcttggcctcgtcggccagggcctgatacttggcggccagcttctcgcgccacaccgtttcgtcgatcaccccgacgtacttgtcgcggatgatgcccttggcgtcgatgaagaaggtttccggcgcgccgtacaccccgaggttcaggcccagggtgccctcctcgtcgcggatatccagctgataggggttgtggaactcgaccagccacttcagggcgtcggcgttgacgtccttgtagttgacgccgtagatggtcacaccctgctgcgccagcttgttcagcaccgggtgctcgacccggcaggaaatgcaccaggtgccccagacgttgaccagcgccggcttgcccagcaggtcggcacgggtcagggtcttgtcgccctgcaccgacggcagggagaactccgggaacggcttgccgatcatcgccgatggcagctcggccgggtccaggtacaacccgcggtacaggaacaccgccaccagcaggaacagcgccagcggcaacaacattatccagcgtctcatgcagtggctcctgtcatgcccagggcttcgcgcacccgggtcttcaccttgacccggtaacgccggtcgagggccgccagcaggccaccgaaaccggtgagcaggccgccgaaccagatccagcgcacgaacggcttgacgtgcacccgcacggcccaggcgccatcgcccagcggctcgccgagggcgacgtagagatcacgggtgaaaccggcgtcgatgccggcctcggtcatcaccgagttctgtaccgtgtagaggcgtttttccgggtgcagcacggcgatttccttgccatcgcagaccacccgcaccgtgcccttgtcggaggtgaagttggggccttcgaaatgcttggcgccctcgaagacaaagtgataaccggccaggtccatggactcgcccggctccaggcgcaggtcgcgctcggcgctattctggctcgacagcaccacgcccagggcgcagaccgcgatgcccaggtgcgccagctgcatgccccagtagctgcgggtcaggcccggcaggcccttgaccaggcctttgtggcgggtcttgtcgaaaatatcgcggaccccggcgagcaacacccaggccgccagcatgaaggtcgccagcactgcccagttgaagtcgccgtagacaataccggccaccaccgccagcgcggcgctgcccagcagtaccggagtcagcatgctcaccagccatttcaccggggtgtctttccagcgcaccaccacgccgatcgccatcaccaccatcagcagcgccatcagtggaatgaacagcgcgttgaagtacggcgggccgaccgacagcttggccccggtcagggcgtccagcaccagcgggtacagagtgcccagcaggatcatcgaggccgccaccaccagcaccaggttgttgcccagcagcagggtttcccgcgaccacaggttgaagccgacctggctcttgaccaccggcgcgcgcagggcgaacagggtcaacgaaccgccgaccacgaacagcaggaagatcaggatgaacacgccgcgctcggggtccgaggcaaaggcgtggaccgaggtcagcaccccggaacgcaccaggaaggtccccagcaggctcagggagaacgcggcgatggccagcagcacggtccagctcttgaacacgccgcgcttttcggtgaccgccagcgagtggatcaacgcggtgcccaccagccagggcatgaacgaggcgttttccaccgggtcccagaaccaccagccaccccagccgagttcgtagtaggcccaccaggagccgagggtgataccgatgccgaggaatgcccaggcgactatggtccagggccgcgaccagcgcgcccaggccgcgtccaggcgaccgccgagcaaggcggcgatggcgaaggcgaaggccacggagaaaccgacatagcccatgtagagcatcggcgggtgcacgatcaggccgatgtcctgcagcagcgggttgaggtcgcggccgtcgccgggcacctgcggcagaatccgcgcgaaggggttggaggtgacgatcaggaacagcatgaagccggtgctgatcatgcccatcaccgccagcacccgcgccagcatcacttgcggcaactgccgggagaacaccgacacggcgaaggtccagcccccgaggatcagcgcccagagcagcaacgagccctcgtgggcgccccacaccgcgctgaacttgtagtaccagggcaaggcgctgttggagttgctggcgacataggccaccgagaaatcatcgaccatgaaggcataggtcaggcagccgaaagcgaaggtcagaaaggcgaactgcccccaggccgcgggctgcgccaggcccatccacagacggtcgccacgccaggcgccgagcagcggcaccacggcctggaccagggcaaaacacagggccaggatcatcgccagatggccgagctcgggaatgaagagtgcggatgtcatcgctcagccctccttggccggagccggcgccatttgcccactgtctttgagggccttggtcacttccggcggcatgtacttttcgtcgtgcttggccagcacttcgtcggccaccaccacgccgtcggcgttgagcttgcccagggcgacgatgccctgcccttcgcggaacaggtccgggagaatgccgcggtaggtaatggtcacggccttgttgaagtcggtgaccacgaagcgcacgtccagcgagtccgccgagcgtcgcagcgagcccatctgcaccatgccgccggcgcggatccgcgtgtcatggggggcttcgccgttggcgatctgggtcggggtgtagaacagattgatgttctgttgcagggcgctcagcgccaggccgacggcaacgcccacgccgcccagcacaccgaggatgatcaacagacgctttttacgcagcggattcactgattgttctcccggcgcagacgacgcgcctcttgttgcaggtaacgcttgcgggccagcaacggcaccgccacgttgaggatcagcaccaccaggcagatgccgtaggctgaccagacatacaggccatgatggcccatggcgagaaagtcggcgaaggaagaaaaactcatgatgccgcctccaggctgttctgcacttcggccctgacccagctggcgcgggcttcgcgcttgagcacttcgagacgcatgcgcagcaacagcacggcgccgaagaaacaatagaagcccagcaccgtcagcaacagcggcagccacatctcgacgggcatcgccggtttttcggtgagggtgaaggtcgcgccctggtgcagggtgttccaccactccaccgagtatttgatgatcgggatgttgatcaccccgacgatggccagcaccgcgcaggccttggccgcgctgtcgcgattgctgatggcgttgcccagggcgatcaggccgaagtacaggaacagcaggatcagcatggaggtcaggcgcgcgtcccagacccaccacgagccccaggtcggcttgccccagatggccccggtgaccagcgccacggcggtcatccaggccccgatgggcgccgcgcattgcagggcgacgtcggccagtttcatcttccacaccaggcccaccaccccgcacaccgccagcatcacgtagatggactgggccagcatggcggcgggaacgtggatgtagatgatgcgaaagctgttgccttgctgatagtccggcggcgcgaaggccaggccccaaacgacgccgacggtgatcagcagcaaggctgcgatgctcagccagggcaacagcttgctgctgatgccgtaaaaccacttgggcgagccgagcttatgaaaccaggtccagttcatactgtttccatcacgggtgccgcgcgctgtcacgcacagccagggtctttactgatcaaaatttgatcagacctcattattcgccgacgctgatcttcaggccagccgctattgcaaaaggtgtcagcgttactgccagggcggtcaggctcccaagccacagcaggtaaccggtcgccggcatgccctgcaaggccgcctgcaaggcgccgctgccgagaatcaataccgggatgtacaggggcaggatcagcagcgccagcaacaggccgccacgcttgagccctaccgtcaacgccgcgcccaccgcgcccagcaggctgagcaccggagtgcccagcaacagggacagcaacagcaccggcagacaggctgtgggcaggccgagcatcagtgccaacaggggcgcaagcaataccagtgccaggccggaaaaggcccagtgtgccagcaccttggccagaaccagaagaggcagggggtgcggcgaaaggacccactgctccagggatccatcctcgaaatcactgcgaaaaagcccgtccagcgagagcaaaaccgataacagggccgctacccagactagccctggagacaaggtttgcaacaattgtgtctcaggtcccaccgccaatgggaacagtgcgacaacgatggcgaaaaacaccagcgggttggccagttcggcgggacggcggaacagcagccgggattcgcgggcaaccagcagtccgaaaacactcatacggcccaatgccccagatcgatgtcgcgatagccggccggcagtcggctcagtgtgtggtgggtggtgaggatcaccatgccgccgcgttcgcagtggccggccaggtgctcttccagttgcgccacgccctgtttgtccagggcggtgaagggttcgtcgagaatccacagcggcgggctgtccaggtacagccgggccagcgccacccggcgctgctggccggcggacagggtgtgacagggcacatcctcgaaaccgcgcaggccgaccgccgccagggcctgccagatcgcctcgcgatcggcgggctgatgcagggcgcagagccagctgaggttttcctcggcggtcaacaggtccttgatccccgccgcatggccgatccataacaggttgcgcgccagctccgcgcgctgggcgttgagcggctggccattgagcagcacctggccgctggtcggctgcatcagccctgccagcaggcgcaacaggctggtcttgccgctgccgttgggaccgctgatctgcaacatgtcgccgctggccagacgcagttcgagcttttcgaagagcagccgcaggtcgcgctcacaggcaagcgctacggcttctagaagaggactggtcaaatgatcgcgggcctttacggttcaagtcggcggtggagcagccgttaaagagatgcagaataaacgcatcggcggcctgttccagagagctgcgtcaaacttttgcgatgttttcgccacgctccccgaagacgggcggcattatacatgcgatgccctactctcaagagggcttatttctccacaggttgtgtccagatgacaggcgaaatcacccttcctccgctgccccaactgacgccgggaaccgtgcgcgcgctgccgatcagtggtgaattgctcaagttgctgcagcccctggaaggcctgatcgccgccggccaatcggccaaggccgaagtactgtcgctcaagcaggcggaccagacgttccaactattgctcaagctgaccctcgacagcggccggcagaccaccgtccaggccaccagcaaccagccgctgcccctgggcaccagcctggcggtgacccagccctcggcgggcaacctggccatcaccgtgcagcaggcgattgccgccagcgtcgccaccctgacccgcctcgacaccgcacagcttcccgtgggcaccctgctgcagggcaaggtgctgaccacccagctacaaccccaggcagccggacaaccggcggtctaccgctcgctggtgagcctgctcaacaccgccctgagcggcagcaccctgagcatcgacagcccgcaacccatgcgcatcggcagcctgctgagcgccctggtgcaaggctcgcagagcttgagcttcgtgccgctgagcgggcgccaggagcaactggcgatcgcccagcaactggccgcccagcaaagccgccaggcctcgctgacgggcctgatcaatgcgttgcagaacctgccgccctccgacgacacctccagcgaactgcgcgccacggtggacaagctgctcgccggcctgcccgacctgcagcaactgagcaatcccaaggcgctggcccaggccctgggcaacagcggcgccttcctcgagtcgcggctgctggccggcgacaatccggccctggcggctgacctgaaaggcaacctgctgcgcctgatcgcccagatgacgccgggcctgccggccagcaccaatttcaacgcgatcattgccgccaataccctggcccaggtgctgccgagcttcgtgcgcagcgccctgggcaccctcggccaggtcagcgccaggccccagccgggtggcttccccctgccctcgcgactgctgcaaagcctcgaggaggaaggcgacctggaacacctgctgcgcctggccgcggccgctgtttcgcgcttgcagagccatcagctggcgagcctggaacagagcggcatgaccgatgacggtcggctgctgaccacctggcaactggaaatcccgatgcgcacgatgcaggacatcgtgcccttgcaggtcaagttccagcgcgaagacccggcggaaaaaccgcccgaggaaaaacgcgaggaacgcgaaccgaaacagcagctgtggcgcgtcgaactggcgttcgacctcgaacccctgggcccgctacaggtgcaggcgcaattgctcaagggccgcctgtccagccagctctgggcgcagcggccatttaccgcgagcctgatcgaaagccatctgggcagcctgcgtgaacggctgctcgcgtccggcctggatgtcggcgatctggactgccatctcggcacaccgccgcagggcccgaaaacccgactggaacaacgctgggtcgatgaaaccgcatgaataattccaacccgccacgccaggccatcgccctcaagtacgacggccagcacgcgcccacgctgaccgccaagggcgacgacgaactggccgaagccatcctgaaaatcgcccgcgactgtgaagtgccgatctatgagaacgccgagctggtgaaactgctggcacgcatggaactgggcgacagcattcccgaggagttataccggaccatcgccgaaatcattgccttcgcctggaacctcaagggcaagttcccggccgggcatgagccgcaggaagcggcgctggagaaggatgtgacggaaagcggggaggattactgatctgtagccgttgccgcgggctgcgatcggccgcaggacctcaggatcgctgaaggccttcggccttggcgcagcctgcggcagcggctacagagggatttcagctcttgtgcagcttgctcatcaactcggcctcggcctgggtcaagccgcaggactgagtcagttcgtcgacgctggcgcccatgcccaccaggcgcgcggcctgggcgaaggacaggctcgacggatcgcgctgttccagctgggccagcttgtccggcaacgggccgaccaccgcgcgcaactcatgcaggtcttcgcccatgcgcaccgtaccgttctgataatcgtcgacgcgcttggccaggtccttgatgcgctgatcgcgcagcgcatcgtcctgggcctgctgggcggcgatctgccgctgagcacggatataggccaggaacatcgccagtgtgcctgcccaaaagaggaacaggacaataaccgcaacctcgagaatcaatcagatactctccagttccgaccactcttcttcgctcatcatcttgtccagctcaaccagaatcagcagctcgccgttcttgttgcacacgccctggatgaacttggccgactcttcgttaccgacgttcggcgcggtctcgacttccgactgacgcaggtaaaccacttccgccacgctgtcgaccatgatcccgaccacttgcttgtcggcttcgatgatcacgatacgggtgttgtcgttgacctcggtgggcaccaggccgaaacgctggcgggtgtcgatcacggtcaccacgttgccacgcaggttgatgatgcccagcacgtagctcggggcacccggtaccggcgcgatctcggtgtagcgcaggacctcctgcacgcgcatcacgttgatgccgtaggactcgttatccagcttgaaggttacccattgcaggatcggatcttcggaactctgtgcggacgacgacttattcatacccctgacccctcaaaaaaccgttggaaacggtgtgtgttctgtgtggccgcaccgtcggcgcagcctgttgttggtctatatcggcttcggcgccggtttgctgatagccaagtgtttcgcgccgccgttggcgatcagctcggccagctcggaaacgtccagcagcgcgcacatatgctcgatgaccgtgcccgccagccatggccgctggccacggtggctgcgccatttgatttcgttcgggtccaggcgcaacgagcggctgacctgatgcaccgccagcccccactcgtagccctggaccgagatcacgtattgcaggccctggcggaaatcgtcgcggtagcgatcgggcatcacccagcgcgcggtatccagcaccttcaggttgccggcctggctcggcaggatcccgaggaaccactccggctggccgaacagcggtgtcagctcatgccccgccagggaatagatcgaccccaggcagaccagcggcaccgccagggtcaacccggcgacatcgaacagcaggcactcgaagggttccgctgcccagctcggccggtcatcagccgccaccggtggcggcgtgctgctgggtggccgatgcacctcgaccaccggttcgaccaggccttgcagcaagggcgcaacggtcgacaaggtggccggcaatggcgcgggcgcctccagcacgggggcgaccaccggttcctcgacccgtactaccggcgcgacaaccacagccggcgcacgctggacttgggcatcgcgagcctgttcttcgagcaccgcggcctggaactcatccaggacctcgctcgacaccgctacttcttctaccgctgcctgaacctgcggcagcgcctcgggaaccgcgaattcttcttcggtggcgtcctgcagcaacgcgtccaggtaggactgcagcgccagctgcggtcgggacgtgacgtcgacaggacggttcataaggatgcccacggataaagcccagcacagtgacctgtagggtttatcggccagaccggcagcagacttgaatgctccgccacgtcaggccacctgcaggacaagttgctgggccagcaggtgcttgagcaaggcgcgataggccagtacgccgcggctcttgccgtcgaactgcgaaggcgtcaatccagcccggctggcatcgcgcaggcgcgtgtcgacggggatgtagccctgccagatctcatccgggaacttgtcgcgcagcacccgcaaggtgcccagggacgcctgggtgcggcggtcgaacagggtcggcacgatgctgaacggcagcgcctgtttgcgcgagcggttgatcatcgccaaggtattgaccatgcgctccaggcccttgaccgccaggtgctcggtctgcaccgggatcaccagttgctggctcgccgccaaggcattgaccatcagcacgccaagcaacggtgggctgtcgatcaccgcatagtcgaaatcctgccacagctgcgccaggctcttggcgatcaccaggcccaggccgctctgccccggcgactggcgctccagggtagccagcgcggtactcgagggcagcagggaaatacgttcgtcgctggtcgacagcagcaactgcccgggcaagccctcggggacgctgcccttgtgcaggaacaggtcgtagttactgtgttccaggctgtcggggtcatagccgaagtagctggtcatggagccgtgggggtcgagatcgaccacgaccacgcgcttgcccgcctcggccagcaacccggctaaagcgatggaactggtggtcttaccgacgccacccttttgattggcaactgcccagactctcattcagattgttcctcccggcaggcacgggccagccgagaaatagcacccagttataaagccggtgacggagaattgacggcactctcgcgtcccggcgtcttgactgacgtaggtgcagtttgtgtgccagcccgcttcaatgccgcatccggtgtcgcatgggcggtgccggtgcctgtcaggctgcggcgtacatcgagattgcgcgacaccaccagcaccacccgacggttgcgggcacggccatcggccgtcgcgttattggctaccggctggaactcgccgtagccgaccgacgccaggcgctgcggattgaccccctgcatcgccagcatccgcacgatgctcgccgagcgggccgacgacagctcccagttggtcgggtactgcgcggtctggatcggttggttgtcggtaaagccctcgacgtgaatcgggttgtcgaagggtttgaggatcgccgccaccttgtcgatgatgttgaacgccaggtcgctgggcatggcatcgccgctgccgaacaacaggctggagttgagttcgatctcgacccacagctcgttgccgcgcacggtcatctggttggaactgatcaggtcgccaaaggccgcgctgatatcgtcggcgatgcttttcagcggatcgctggcaccggcgataccggcgtcggtctgctcgctgtccttgaccagcggcttggccggggtcacggtctggggccgctcctcaccgatgggaatcggtttgagggcgcggtccgaatcggtgaacacgccgatcagcgcttcggaaatgaccttgtacttgccctcgttgatcgaggagatcgagtacatgaccacgaaaaaggcgaacagcaaggtgatgaagtccgcgtaggacaccagccaacgctcgtggttgacgtgttcttcatgccggcgacgacgggacatagtccattacccccatcaatccatgaagccttgcagcttcaactcaatggaacgagggttttcaccttcggcaatcgacaggattccttcaagcaacatttcgcgataacgcgactggcgcaaggctatggacttgagcttggcggcgatcggcagcaataccaggttggcgctggccacgccgtagatggtggcgacgaaggccacggcgataccgctgcccagttgcgaagggtcggccaggttgcccatcacatggatcaggcccatgaccgcaccgatgataccgatggtcggcgcgtagccgcccatgctttcaaagaccttggccgcttcgatgtcgcggctttcctgggtgtagaaatccacttccaggatgctgcggatggactccggctcggcaccgtccaccagcagttgcaggcccttgcgcgaataggtgtcgggctcggcatcggccacgccttccaggcccagcaggccttccttgcgggcggtcaggctccagttgacgacacggtcgatgcccccgggcaggtcgacccgcggcggaaacaggatccagccgaggatctgcatggcgcgcttgaaggcgctcagcggcgattgcagcaacgccgcgccgatggtcccgcccagcacgatcagcgccgccgggccattggccagggccgacagatgaccgccttccaggtagttgccaccgatgatggcgacgaacgccatgatgatcccgatgaggcttagaacatccatcagagacaggcctcgaccaggtgcttgccaatgtcgtccaggccgtacaccgcatccgccagctccgccttgacgatcgccatcggcatcccgtagatcacacagctcgcctcatcctgggcccagaccgcgctgccgccctgcttgagcaggcgcgcgccttcgcgaccgtcggcgcccatgccggtgaggaccaccgccagaactttgtcgccgtaggacttggccgccgaaccgaaggtgatgtccacgcacggcttgtagttcaggcgttcgtcgcccgggaggattttcaccgcgccacggccgtcgaccatcatctgcttgccgcccggtgccagcagcgccaggcccggacgcaggatgtcgccatcctcggcttccttgacgctgatccggcagagcttgtccaggcgctcggcgaacgccttggtgaaggccgccggcatgtgctggatcagcacgatcggcgccgggaagttggccggcaactgggtcagcacccgctgcagcgccaccggaccaccggtggaggtaccgatggccaccagtttgtaggccttgcgcttgggcgccggcgacgacgcgccagcggccggcgtgcggccgggaatcggcgccggagccgggcgcgccggggccgtgccgccgaagctgctggtgctcgttggcgcaggcttcggtgccgccgccggttgtggcgccggcgcactgtagctgctgaaacgacggttactgcgcgagatgctatggaccttctcgcacagcagttgcttgaccttctcgggattgcgcgagatgtcttcgaagttcttcggcaggaaatccaccgcgccggcatccagcgcatccagggttacccgggcgccttcatgggtcagcgaggagaacatcaataccggcgtcgggcagcgctgcatgatgtgccgcacggccgtgatgccatccatcatcggcatctcgtagtccatggtgatcacgtccggcttgagtgccagcgcctgatcgatcgcctctttgccgttggtcgcggtaccgacgacctggatattgatatccgctgaaagaatttccgagacgcggcggcggaaaaaccccgaatcatccaccaccaggaccttgactgccataaacactccgttaggcggggcaaggcaaatggccccgcccctccggtattcaaatacgccgtgcggcgtaacgcttgagcatgctcggaacatcgagaatcagggcgatgcggccgtcaccggtaatggtggcgcccgacatgcccggggttccctggagcatcttgcccaatggcttgatgacgacttcttcctggccgaccagttgatcgacgacgaagccgatccgctgggtgccgaccgaaaggatcaccacatggccttcgcgctgctcttcgtgagcggcggagctgaccagccagcgcttgaggtagaacagtggcagggccttgtcgcggacgatcaccacctcctggccgtcgaccacgttggtgcgcgacaggtccaggtggaagatttcgttgacgttgaccagcgggaacgcgaacgcctggttgcccagcatcaccatcagggtcggcatgatcgccagggtcagcggcaccttgatgacgatcttcgaaccctggcccttggtcgagtagatgttgatcgaaccgttgagctgggaaatcttggtcttcaccacgtccatgcccacgccgcggccggacacgtcggagatctcggtcttggtcgagaaacccggggcgaagatcaggttgtagcactcggtgtcgctcaggcgatcggcggcatccttgtccatcaccccacgcttgaccgcaatggcgcgcaggacgttcgggtccatgcctttgccgtcgtcggagatcgacagcaggatatggtcgccttcctgctcggccgccagcaccaccttgccgccacgggacttgcccgaggcctcgcgctcttccggcgactcgataccgtggtcgacggcgttgcgcaccaagtgcaccagcgggtcggccagggcctcgacgaggttcttgtcgaggtcggtctcttcgccgaccagctccaggttgatctctttcttgagctggcgggccaggtcgcgaaccagacgcgggaagcgcccgaagaccttcttgatcggctgcatccgggtcttcatcaccgcggtctgcaagtcggccgtgaccacgtcgaggttcgacacggccttggacatggcttcgtcgccgctgttgagccccaggcgcaccaggcggttacgcaccagcaccagctcgccgaccatgttcatgatttcgtccagccgcgcggtatcgacccgcacggtggtttcggcttcgctgaccggcttttccgccggggcggcagccggagcacgagcgggcgccgcagcagcggctggagccggctttggcgtttcggccttggcttcaggcttcttcaccgctggcttggcgacggcggcaggcgccggagccgtgacggccgttgcgctacccacggtcgccgcggcagcgggcacttcagagaacttgcccttgccatgcagctcgtcgagcagggattcgaattcctggtcggtgatcaggtcgctaccagcggcggccgcgcttggtgctgccggcggcactgccgccgccaccgcggagtccagcgcatcgaccgcaaagttgcctttgccatgcagctggtccagcagggcttcgaattcgtcatcggtgatttcgtcgctgggcgcggctttttccgcagccggcgccgtggccgaaggggccaccgcatccggtgcgaactggcccttgccatgcaattgatcgagcagcgactcgaactcggcatcggtgatttcgtcgctggccgcttcgctgccgacggcgggcgccgcgggagcaacagcagccggggcttcggcctcgaccttggcggcattgagcgaatcgagcagctgctcgaactcgctgtcggtgatatcgccggactcgctttcggtcgattcggcgaccggttcggtaacggcttcaacaactgtctcaacctcggccaccggcgcggcgacctcctcggcccccgcaggctcggccaggcgggccagggcagccagcagctccggagtggcggcggtgatctcggtacgctcgcgcacctggccgaacatgccgttcaccgcgtccagtgcttcgagcaccacgtccatcagttccgcgtcgacgcgacgctcacccttgcgcaggatgtcgaacacgttctcggcgatgtggcagcactccaccagctcgttgagctggaggaagccggcgcccccttttacagtgtgaaaaccgcgaaaaattgcgttgagcagatccgcatcgtccggccggctttccagctcgaccagttgttcggacagttgctctagaatctcgccggcctcaaccagaaaatcctgaaggatttcttcatcggcgccgaagctcatgtatgggtgctcctactaggtcgtgatgacggttaatgacggatcgcgttggaactgtgagcgtgccaggcaaggcgcgagacgctggcaagggtcgtttccttgccgagtctcgcaacgccgcatggcgcgctcacagttccaacccttcgggccgcgccccgcaaggcgcaatccgtcgttactcgtcgctcatttggaaaaaccaaaccactctcctcgtgcctagtcttgcgccttgcggggcggcggcgcgaccgtcattaaccgtcgtcacgacctaaaatccaaggctggaaagcaaatcgtcgacatcgtcctgaccggatacaacgtcttcacgtttatcggcatgaatctgcggaccttcacccttggccagatgtttttgcggatctttttcagcgaggatcgattcgcggtcatgttcgatgccggcaaaacgatcgacctggctggccatcaggaccagtttgagcaggttgctctcgacttcggtgaccaactgggtcacgcgcttgatcacctgaccggtcaggtcctggtagtcctgcgccagcagaatgtcgttgaggttgctcgataccgcgcgcgtctcttgctcgctgcgggtcaggaaaccgtccacccggcgggccaggtcgcggaattcctcggcgcccagttcgcggcgcatgaaacgcccccaatcggcgctcagggcctgggcttcgctgctcagaccattgaccagcggggtggcgctctcgaccagatccatggtgcggttggccgcggcctcggtcagcctgaccacataggacaggcgctcggtggcatccgtgatctgtgaaacttcctcggcttgcggcatatgcgggtcaatctggaaattgacgatggcgctatgcagctcgcgggtgagcttgccgacctcctggtacaggccgcggtcacgggtctggttgagctcatggatcagttgcacggcttcgccgaacttgcctttttcaaggctgtcgaccagttcgagtgcgtgttttttcagggtcgattcgaaatcgcccaatgaagattcgttgtgctccatagctcccccgtggcggaatgattccactctcaaccgatgcgttcgaagatcttctcgatcttctctttcaacgcctgggccgtgaagggcttgaccacataaccgtttacgccggcctgggcagcttcgatgatctgttcgcgcttggcttcagcggtcaccatgagtaccggcaggtgcttgagtttttcatcggcgcgcacatggcgcagcagatcgataccggtcatgccgggcatgttccagtccgttaccagaaagtcgatgctcccactgttgaggaccggaatggcggtggtgccatcgtcagcctcgaccgtgttggtgaaccccaggtcacgcaacaggttttttatgatccgccgcatcgttgagaagtcatcaacgatgaggattttcatgttcttgtccaattcgacctccaagcagtcttaaacgcgtccagcacctgaacgcgccattcaatcaatcaggcagagcactcaacgactgcatggaatacacaccgcaagtccggccacgtcgtgccagtctcgtccgcagtgtcccccacactgcctgtcagcgcgctcgccactctcccaaacgcccccgcaaacgggccgcgcactggctgtgtaactggctgacccgcgattcgctgacccccaggacctcaccgatttccttgaggttcagctcttcgtcgtagtacagcgccaagaccagtcgctcacgctccggcaaattggcaatcgcgtccgccagcgcggcctggaaacgttcgtcctccaggtcgcgcgacggctcgagatgagcactcgcgccatcctcatgcagcccttcatgctcgccgtcctgcaacaggtcgtcgaagctgaacaggcgactgcccaaggtgtcgttcaaaatcccgtaataatcgtcgagactcaattgaagttcggccgcaacttcatgatctttagcgtcacgaccggttttagcttcaattgcgcgaatggcatcgctcaccatccgggtattgcgatgtaccgaacgcggcgcccagtcacctttacggacctcatcgagcatcgcaccgcggatacggatacccgcgtaggtctcgaaactcgcgcccttgctcgcgtcgtacttggtcgacacttcgagcagaccgatcatcccggcctggatcaggtcttcgacctggacactggccggcaggcgtgccagcaagtgataggcaatacgcttgaccagaggcgcatagcgctcgatcaattcgtactggctgtcacgtgccgactttttgtaaaggttgtagccgctggcgctcatagcaccggtcccgctgtctgatgcacgagccgctcgacgaaaaattccagatgtccgcgtgggttggccggcaacggccaggtatcgaccttctgcgcgatggccttgaacgccagcgcgcatttcgaacgcggaaacgcctcatagaccgcacgctgcttttgcacggccttgcgcacgcattcgtcgtaaggcacggcgccgacatattgtagggccacgtccaggaagcgatccgtgaccttggtcaacttggcgaacaggttgcgcccttcctgcgggctctgcgccatgttggcgagcacgcggaagcggttcatgccgtagtcgcggttgagcagcttgatcagcgcgtaggcgtcggtgatcgaggtcggctcgtcgcagaccaccagcaatacttcctgggccgcgcggacgaagctgaccaccgagtcgccgatgccggcggcggtgtcgatcaccagcacatcgaggttgtcgccgatgtcgctaaaggcctggatcaggccggcatgctgcgccgggctcagatgaaccatgctctgggtgccggacgccgccggcacgatacggattccacccggcccctgcagcagcacatcgcgcagctcgcagcggccttcgatcacgtcggcgagggtccgtttgggggtcagccccaatagcacgtcgacgttggccagacccaggtcggcgtccagcagcatgacgcgccggccgagctccgctagggccagggacaagttcactgacacgttagtcttgccgacgccacctttgccgccggtcaccgcgatcacctgtacgggatgcatgctgcccatgttctttctttaccttgtcttacttagacggggccacataactggctgcgcgttcaccaacggaacaatgcctggcagaccatcgatgtaggtacattgcaatcttttcatgattccctcagccaacccgcttggtcgggttgtggtagaggtcagcgaacatgtcagccatggcttcttcgctgggttcttcctgcatctgcacgctcaccgcacgactgaccagctgatgacggcgcggcaagtgcagatcgtccggaatccgcgggccatcggtcagataggcaacggggagttcgtgactgatcgccaggctcaacacctcaccaaggctggcggtttcatccagtttagtcaggatgcagccggccagcccgcaacgcttgtagctgtggtatgcggcggttagaacctgtttctggctggtggttgccaagaccagataattttttgcccggatgccacgtccggccaggctttccagctgcatgcgcagggccgggtcgctggcttgcaggccggcggtgtcgatcagcaccacgcgcttgcgcagcagcggatcgagggcttgcgccagggactggcccgggtcgacatgggtcaccgagacgttgaggatccggcccagggtcttgagctgttcctgggcgccgatgcggtagctgtccatgctcaccagcgcgatgttctgcgcgccgtacttgagtacataacgcgcggccagcttggccagggtggtggtcttgcccatgccggcggggccgaccatggcgatcacaccgccctcctccagtggctcgacttccggggtcacgatcatccgcgccaggtgggccaggagcatgcgccaggcctggcggggttcgtcgatttcagtgatcagcgccagcaggtcgcgggccagcgggccggacaagccgatacgctgcaggcgccgccagaggttggcctgctcgggccggctgccttgcagctggctccaggccagggagccgagctggacttccagcagctcgcgcaggccgttgagttcaaaacgcatcgagtccagtgcccgctgatcgacagccggcgcggcgactaccggggccgggcgctgcggctcgttgaacgtaggttcgatcagcggctcggcggcggtcagcggcaagccggcgaacagctggcgattggtgctggcatcgccatcgccacgcaggctcagttcggcctgggcggtgacgatgcgcgactgagtcttgcgcagttcgtcctcgagttccatgttcggcacccgtggcgccagcgccgacagcttgtaatccagggcagccgtcagctcgacaccgccggcgatgcggcgattgccaatgatggcggcgtcggcgcccagctcatcacgaaccagcttcatggcctgacgcatatcggcggcgaaaaaacgcttaacttgcataacccactacctcagccgttgggccctactgtcgcaacgatggtcacttgcttgttgtcagggatttcctggtacgccaacacgtgcaagcccgggaccgccaggcgcccgaaccgcgagagcatcgcgcggaccggaccggctaccagcagaatcaccggttgaccttgcatttcctggcgctgcgcggcttcgatcaacgaacgctgcagcttctcagccatgcttggctccaacaggacaccctcttccgagccttgtcctgccttctgcagactattgagcaaaatctgttccaacctgggttccaaggtgatcacaggcagctcggactcagtgcctacaatgctttgcacgatggcgcgcgacaatccgacacgcaccgcggccaccaaagcggcagtatcttgactcttggcggcattgttcgcgatggcttcggcaatgctgcggatatcgcgcactggcacctgttcggccagcagcgcctgcagcaccttgagcagctgggacaacgaaagcacgcccggcaccagctcttccgccagcttcggcgagcccttggccagcaattgcaggagctgctggacttcttcgtggccgatcagctcgctggagtgcttgtacagaatctggttgaggtgggtggcgaccacggtgctggcgtcgaccacggtgtagcccagcgactgcgcctgggcgcgctggctgatttcgatccacaccgcctccaggccgaaggccggatctttggcgttgatgccgttgagcgtgccatagacctgccccgggttgatcgccagctcgcgatccgggtaaatctcggcctcggccaggattacccccatcagcgtcagccggtaagcgctgggcgccaggtcgaggttgtcgcgaatatgcacggtgggcatgaggaagcccaggtcctgggacagcttcttgcgcacgcccttgatccgcgccagcaattgcccaccctggttgcggtccaccaggggaatcaggcggtagccgacttccaggccgatcatgtcgatctgggtcacatcgtcccagcccagctccttggtttcctgggcacgggccggcgatggcagcagttcctgctggcgcttgacctcttccagcgccttgaccttgaccacgttctggcgtttccagaacaggtacgcgccgccggccgccagggccgccatgctcaggaaggaaaagtgcggcatgcccggcaccaggcccatcaccgccatcaggccagcggcgacagccagggcccggggcgaggcgaacatctgccggttgatctgcttgcccatgtcttcggaaccggaagcacgggtcaccatgatcgcggccgcggtggacagcagcagcgatggcaattgcgccaccaaaccgtcaccgatggtcagcaacgcgtagacccggccggcatcgccgaaggacatgtggtgctggaagataccgaccgccatgccaccgatcaggttgatgaacaggatcagcaggccggcgatggcgtcaccgcggacaaacttgctggcaccgtccatggaaccgtagaactcggcctcctgggccacttccgagcggcgggccttggcctgggcctggtcgatcaggccggcgttgagatcggcgtcgatggccatctgcttgcccggcatcgcatcgagggtgaaacgcgcgctcacctcggaaatccgcccggcacccttggtcaccaccacgaagttgatgatcatcaggatcgcgaacaccacgataccgaccacgtagttaccgccgatcaccacctcgccgaaggcctggatcactttaccggcggcggcgtgaccatcctggccgtggagcatcaccacccgcgtggaggccacgttcagcgccagacgcaacagagtcgccaccagcaggatggtcgggaataccgcgaaatccagcggccgcagggcatacacacagaccagcagcacgacgatcgacagggcgatgttgaaggtgaagaacacgtccagcaggaacggcggcaccggcagcatcatcatggccagcatgaccagcagcaacagcggcacccccaggttcccccgactgaggtcggccaggttagtgcgagccgtactgattaactgagagcgatccaccggtattccccgttcccttgaagcaaacttttgacgcctggaggcggcgcagggcgggtattgcaagaagccttccaactttggcctggaacacaaactgatttatggcgttgcgccatcaggcgtcacacaaggcgctttcgcgccatcgcgagcacgctcgcgcctacaggccgggcgtggaccctgcaggagcgagcttgctcgcgataacgtcggcacagccaacgccgacctcaggaatcgcgacgcaaatccggcggaatcggcaggtccttgagcggatcggggcgcttgcccttgccggcccggtgctggcgaatctgatagacatacgccagcacctgggccaccgccagataaagcccggcggggatttcctgctccagctcggtggagtaatagatcgaacgcgccagcgccggcgactccagcaacaacacctcgttggccacggcgatctcgcggatcttcagcgccaggaaatcgctgcccttggccagcaacaccggcgccccgcccttctcggcgtcgtacttgagcgccgcggcgtagtgggtcgggttggtgatgaccacatccgcctcgggaatcgccgccatcatccgccgctgcgacatctcgcgctggacctggcgaatgcgctgcttgacctcggggcgcccttcctgatccttgtgctcgtcacgcacttcctgcttggtcatcagcagcttcttgtagctctggtacagctgcaccggcacgtccaccgcggcgatcaggatcagcccgcaggccatccacaaggtgctccaggccaccacttgcacactgtggataatcgcctgctccagcggctcgtgggcgatccgcagcaggtcgtcgatatccgaagacagcaccgacaaggcgacgatcaggatcaccacgaacttggcgaaggccttgagcaactcgatcagcgaggtcggggacaccatgcgcttcatgccgctgagcgggttcatgcggctgaacttgggcgccaggctcttggtggaaaacagccagccgcccaaggagataggaccgatcagcgccgccagcaccaggggcagcaggatcggcatcgcggcgataatcgcgatcttgcccgaatgcagcaggtacaggcccatggcgccggggctgagcagcacctcgcgcggcagggagaaattcaggcgcatgatttccagcaggtcctgggccactcccgcgccgtagatcagcaggccggcggcgccgatcatggtgatcgccagggtgttgagttccttggagcgggcaatctcgcccttttcccgggagtccttcttgcgtttctccgtggggtcttctgtcttgtcctgaccgctctcgctctcagccatggctcaacgcgcctgtgccaggttgcgcaacaactgcagggcctcgacggccagcggttggtactggttgagaatgtcgcccaggctgacccagaaaatcaccaggcccagcaccagggtcagcggaaagccgatggagaaaatgttcaactgcggcgccgcgcgggtcatcacgccaaaggcaatgttcaccaccagcagcgcggtgatcgccggcaataccagcaacagcgcggcgcccagcacccaacccagcttgccggcgatttcccagaaatggttgaccagcagcgcgctgcccaccggcaaggtggtgaagctctcggtcagcacctcgaagaccaccagatgcccgttcataccgagaacagcaaggtcaccagcatggtcaggaattgcccgatcaccgccgccgaaacaccgttggtgggatcgaccatggacgcgaagcccatgcccatctgcgtcgaaatgatctgcccggcgatcacgaaagcctggaagaacaactgcagggagaaaccgaacaaggcgccgatgatgatctgctcggcaatcagcagcagcccgctgagatccagtgcattgaccgccggcatgggcggcaggcccggcaccaccacgaccgtgatggccagggtgaaatacaggcggatacgggtcggcaccagggtcgtgccgaagaccggcatggtcatcaacacggcgccgatacgaaacagcggcagcatgaagctggcgacccaggtgctgatctgcgtatcggtaagcgccagcagagacatggcttagccgatcaactgcggaatactgccgtacaactgcaggatgtattccatgaaggtctgcaccagccagggaccggcgacgatcagcgtcaccagcatcaccagcaggcgcggcaggaagctcagggtctgttcgttgatctgggtggcggcctggaacatcgccaccagcaagcccaccagcaggctggggattaccaggatggcgaccatcatggtggtcagccagagcgcttcgcgaaacaggtctaccgcgacttcaggcgtcataatgcgtcacccgccaacaaggttctaaacaccaccgaaactgcccgccagggtgccgatgatcagggcccagccatccaccagcacgaacagcatgatcttgaacggcagggaaatgatcagtggcgacagcatcatcatgcccatggccatcagcacactggcgaccaccaggtcgatgatcaggaacggaatgaagatcatgaaaccgatctggaacgcggtcttcagctccgaggtgacgaaggccggcaccaggatcgtcagcggcgcctggtccggcgtcgcgatatcagtgcgcttggacaggcgcatgaacagctccaggtcgctgctgcgggtctgtgccagcatgaaatccttgatcggcacctgggccttggccaccgcgtcctgggcgctgagcttctccgccaggtacggctgcagagcatcttggttcacccggtcgaacaccggggccatgatgaacatcgtcaggaacagcgccatgccggtgaggatctggttcgacggcgtctgctgcaggcccagggcctgacgcaggatcgagaacacgatgatgatccgggtaaagctggtcatcagcatgacgaacgccggaatgaagctcagcgcggtcatgatcaacaggatctgcaggctgaccgagtattcctgctggccgtcggcattggtgccgagggtgatcgccgggatcgacaacgggtcggccgccagcgccagcggcgccgccagcatcagggccaacatcaagaggaggcgcaacggcattacttcttatccttctgatccttgcccagcagctccatcaggcgctgggcaaactccggagtcgcctgctcggtgctcggcacctgcaccggctccttgagcacatgcaacgcagtgatggtgcccggtgtcaggccgagcagaatctgttcgttgccgacctgcaccagcaccagccggtcccgcgggccaagcgcccgcgagccgatcagctcgatgacctggcccttgccgaccggtccggcctgctgcacccggcgcaacagccaggcgaggaagaagatcagccccaccaccagcaacaggcccagcaccagctgggtcagctgcccggccacgccgctgctgccaaccgctggcgcggcggtaccggccaccggctcggcggccagggcccagagcggccagaccaggaacagcgcgagtgcctttctcacttagcgcagcttcttgatgcgttcgctcgggctgatcacgtcggtcaggcggatgccgaacttctcgttgaccaccaccacttcgccatgggcgatcagcgtgccgttgaccagcacgtccagcggctcgccggccaggcgatcgagttcaatcaccgacccctggttgagctgcagcaggttgcggatgttgatgtcggtgctgccgacctccatggagatcgataccgggatatccaggatcacgtccaggttcggaccgtcgagggtcaccggctcgttgttcttcggcacgctgccgaactcttccatcggcaggcgattggacgccggcgcgctggccgcatcggccgccagcaaggcatcgatatcgtcttgcccggcgtcgccggtttcctgcagggcagccgcccactcatcagccagggcctggtcttctgcggaagtcatttcgtgttcgtcagccatgttgtcctcggcgggcaaaaaatcattaacaaagcgaattcataacaacgccgctcaacggcgctcgatcggctcgatcacttgcagggccaggttgcccttgtgcgaaccgagcttgaccttgaacgccggtacgccgttggcgcgcatgatcatgtcttcaggcagctccaccgggatcacatcccctggctgcatgtgcaggatgtcgcgcaggcgcaactgccggcgggccaccgtggcgctcaaaggcacatccacgtccagcacgtcttcgcgcagggccttgctccagcgctcgtcctggtcgtccaggtcagactggaagccggcgtcgagcatttcccgaaccggctcgatcatcgagtacggcatggtcacgtgcaggtcgccgccgccgccatcaagctcgatgtggaaggtcgagaccacgatcgcttcgctcgggccgacgatgttggccatggccgggttcacttcggagttgatgtactcgaagttgacttccatgatcgcctgccaggcttccttcaaatcgacgaaggcctgctccagcaccatgcgcaccacgcgcaattcggtcggggtgaattcacggccttcgatcttggcgtgacgaccgtcgccgccgaagaagttgtccaccagcttgaacaccagcttggcgtcgaggatgaacagcgcggtaccgcgcagcggcttgatcttcaccaggttgaggctggtcggcacgtacagcgagtgcacgtattcgccgaacttcatcacctgcacgccgcccaccgccacgtccgccgaacggcgcagcatgttgaacatgctgatacgggtgtagcgggcaaaacgttcgttgatcatctccagggtcggcatgcgtccgcggacgatgcgatcctggctggtcaggtcgtagcttttgacgctgccgggctcggcggcgtgttcggtctgtaccagaccgtcatcgacgccatgcagcagcgcgtcgatctcatcctgggacagcaggtcctgcacggccatgtcgtgttcctactgcagtacgaagttagtaaagagcaactgctcgaccaccactttgccgacctctttctgggccacttcctgcacgctggcggtggccttctgacgcagcatttcctgaccgaccggagtcgccagggtgtcgaagctctggccggagaagagcatgaccaggttgttgcggatcaccggcatatgcactttcagcgcgtccagatcggcctggttgcgcgccagcagggtgatgctcacctgcatgtaacgctggcggccgttctgcgtgtagttggccacgaaggctggcgccatgggctcatagatggccgccggcttgacgctgctggtcgcctcggccgtctcggcaggcttgctctgggcactgctgtgcatgaagtaccaggtcgccccgacggacaaaccgatcgccagcaacaaggccagaacaatcaagaggataagcttgagtttgcctttcccggcgggggttttctctgctgcttcgctcttcgccatgccaataatccgtcactaatcgggttttcacagtcgcacggcaaggcaagagcaagtgttatgccagatttgtctgaattggggtgaactgaagggataggggaagcgcaaagcaaaagatcgccagccgcggcgtcacacggctggcgatcttctgttcaatgacgcccgaagcgggtcaggcgtaatagtcgacggcgctgctgccgatgaccgtgctggtgctggcggcgacttcggcgacgctcggcggcaactcttcatccacgccatccaggcgcccaccgctggcgctggctccgttgctgcgatgctgcccctgctgggcctgctcctggccaccctgccagttgcgcgactggtcggagacgttgacgtccacctgccccatgccttgctggtggaacatgtcgcgcaggcgatgcatctgcccttcgagggcctcgcgcacgccgacatgggcactcatgaaggtcacctgggtctgctggtccggcaccatgttcacgcgaatgtccaggcgccccagttcggccggctgcaactggatctcggccgacttcagattgacgctggacaggtacatgacccggttgaccacttcttcggtccagccgctctgatgcatggccagcggctggttcaccgggacggcattagcggtcttgggcgtggccgcctgggtcagggccgccaggcggttggcgaaatcgtcgacgcgggtgtcgctggcagcgctcttgaggtccttgagaccgtcatcgagcaggccgctgaaggccttttcgccgccctgctcggtgctgtccttgtccacctgcaggtccagcatagtggccatgccgctggcgaaggtctgcgccgaagtcggcccatcatcggccaccacggtcggtgccgccttgctctgcgcctgactggaagccgagacatggccgctctgctccatggccaggcgcaccaccggcagcgcatccagcgggtcggcttcagggtcgaattccggatcgaccggcgccggcgtcgcggtgctggccaccaccggtataaccggctgcgtttgcggctgcactggcggctgtgccggaaccggcgcggccgccacttccggctcgggcgccggcaacggcaccggctgggtcgcctgcatcagcgccggatcgagggtcgggtcgaccggcgtgctctcggccagcagcttatcgctgctcgcgacctggtcatcggcgactttttcgtcactggcaacagccttgtcggcaggcaaggttttgccgctatcggcaaccgcaggctcggcggcggcagccttgcccttgcccggatccaccttggcagcggtttcgccccccttgtcgcgagccggcttgctcgggccgtcggcagccgctaccggcttgccgagtgcctccctggcgaacacccgggcaaagcttgcgcctttgtccccgggctcggcggcgctggcctggggggtgacggaagccgcttgagtcttggcctgggaggcggcctgaagaagcatgttcggggtaaggggcatgaaaacggtctccgctgcactgggatcgtaggtacagttgggaaacttgattgcaaaggtcgagccagctttgctggctcacggggaaaagcctggattgcagcggtttttcagcagtgaaaacgctggcgttcctgctcgcacagctggcggacaatggcgaattcgccatcgatctcgccgaccagctgctcgataccgcgcaacgacgagccctgggcacgctgctccaactgatgacagagttcggccaggcgaatcgcccccatattgctgctgctgcccttgaagctatgggcagtggcgacaagttgacgggggtcgtcgaccttgtgcaactggcgcaaacgctcttcggagtcacagaggaaggtgtcgagcaacaacggatactcatcctccatgacttcctgcaatgcgttcagcacctcgtgatccagatgaatctcagacacttgctcactccttgatcaagaatcggcgaattatgccagaggctcccaagaaaactccacgcaggcactacgaccatcgtcagaccagctggcacgccggctgagctgacggatcaggctgacgccgcgcccggaaaggcggtcaccatcgatgggccgcgccatcacccgcccgacatcgaaaccgctgccactgtcctcgacccggatcagcaagcgaccgcctgccccttgaggctccacttgcaggtgcacccgcacaaaaccctcctgcaaggcttcaaggcgtaccgcgcgctcccggtaatagcgggaaaacccctgggcatcgcgcttgaggctcgagtccaagcccaatacgccatgctccagggcattggaatacaactcggccagcacactgtagagcgccccgctctgtgcccgcaggccatgcacttccagcagcagctgcaacaggtaaggcaaagggttgaaacgtttgagggtcgcggcgcgatactcgaaactcgccgaccagtccaacgggcaggactgaccgctgtcggagtacaccaacgccggcggcgtcagcttccgcgcctcgagcaggctgacctcgaccatgctcacatcgtcccgcgcatccccgccaaactcgctcagggcccgctggatctcctcgaacaacaggtccggctcgcggttggcggcaaacacccgctgcaggcgctcgacaccgaacaactgctcgttggcgtcgcaggtgtcgatcaccccatcggacaacaggaaaacccggtcgcccagggccatgggaaagacttcggtgcggtcgtcgaatgcctcggcgcccagtacccccagcggcagatgatgcgccaccagcggcacccgctccccgcttgccaggcgatgcaggtagccatccggcatgccgccgttccacacctccaccgcccgccgctggaagctcaggcacagcagcgtcgcacaacagaacatgccgaccggcagtatgcgcttgagcttggcattcatctcgcgcagggtttcgggcagcccgtaacccttggccgtcatgccgtaaaacacctcggccaagggcatcgcgcccaccgccgccggcaagccgtggccagtgaaatcccccaacagcacatgcatgtcgcccgtcggggtaaaggcagccagcagcaaatcgccgttgaacagcgcatacggcgactgcaggtagcggatattcggcgcattcaggcagccggaatgcgccaccttgtcgaacaccgccttggccacccgctgctcgttgagcaggtagtcatggtgctgggtgatctggtcgcgctgctgcagcacggtttcctgcaggcgccgcaagcgatccatggccttgatcttggcggccaggatcaccgggctgtagggttttgccagaaaatcgtcgccaccggcttccaggcagcgcgccaacgcctcgctctgggtgagcgaagtcaggaaaatgatcggcaccagcgcttcgccagccagatgcttgatctgccgggccgcctcgaaaccgtccatcaccggcatcatcgcgtccatcaacaccaggtgcgggcgctgctggatgaacagttccaccgcctcggcgccgttactcgccgtcagcacttcgtgcccctggcgccggacgatgctcgacagcaacaggcggtcgctggtgccgtcctcggcaatcagcacgcacagaggcgcctcactcgactgcatgtcgatcaactgatgtcgaacagcttgtcgaaattggaaatggcgagaatcttgcgcacgtccgagttgctgttgatcactcgcacgtcggaatcgtcgccgccggcgtgatcgcgcagcaacaggagcatgcccagggcggaactgtcgaggtaagtggcgtctttcaggtccaccactatggagtcgggccttgtgttgaggtgctcgtaggactcgcgaaactcttgatgacggccgaaatcgaaacgccccttgatcgaaatcgtcagtttgtgcccgtccggtgaaacttcagtaacgactgacatgattcgcttccttgtgattggcaatctgtacaaggtttagcaccccgtacaagcctgggcaacccgaaccgccgaagcgtcgctgacgagcgcctagcggcgacgaatggggtggcgctcagtacggatcctggcgcggcaggcgctgggacagctcatcgagcagcttctgctcgcgcttgtcttccagttgccgggcttcatcgatgtagcgttgcaccagcttgcgcaaaccctcgacccgggcataggcctgctgccaggtttcccgggcgcggttgaggttgttctggtgccaggccaggctttgccgctgctggcccacggcggtttccagctgattgaggaagtgctggtagttcatcagccactggccggaaaccccagcactgccccgttcgatccactgttgctggtattcggcacgaaagcgttccaggtcccccagtttgctttccgccaggcgcacctggccctggaaatgccccaggcgctgggcggcggtgcgctcggcgctttcggccatgtcgaccaccggcgccagacgcgcggcacggctgttggccatgatggattaaccgcccggcgccggagcgaacaccatctccagatgggcttcgctttcacccaggctgatgctgtcgttgagcccctggcgcaggtaggcaaccatcgacggctgcagcgagatggcggcgtcggtttcgcgatcgccgcccggtacgtaagcgccgacgctgatcaggtcgcgcgcctgttggtaacgcgaccacagctgcttgaaatactgggcgcgagtcatgtgatccggggtcaccaccgccggcatgacccggctgatggacgcctcgatatcgatggccgggtaatgcccctcttccgccaggcgccgcgacagcacgatgtgcccgtcgagcacaccgcgggccgagtcggcgatcgggtcctgctggtcgtcgccttcggacaacacggtatagaacgcggtgatcgaaccgccaccggcctcggcgttgcccgcgcgctccaccagcttcggcagcttggcgaagaccgacggcggataacccttggtcgcgggcggctcgccgatggccagggcgatttcccgctgggcctgggcgaaacgggtcagggaatccatcagcaacaggacgttcttgcccttgtcgcgaaaatattcggcgatacgcgtgcagtacatggccgcccgcaggcgcatcagcggcgcatcgtccgccggcgacgccaccaccacggagcgcttgagcccctcttcaccgaggatgtgctcgatgaactccttgacctcacgaccccgctcaccgatcagcccgaccacgatgatgtcggcctcggtaaagcgggtcatcatgcccagcagcacactcttgcccacgccggtaccggcgaacaggccgagacgctggccgcggcccaccgtcaataatccgttgatgcagcgaatgcccacgtccagcggccggctgatggggtcgcgcttgagcgggttgatggtcggaccgtccatcggcacccagtcctcggccttcatcccacccttgccgtccagcgcacgaccagcaccgtcgaggacccgcccgagcatgctcatgcccatcggcaggcggccagtatcggccagcggcacgacccgggcgccgggcgcgatgccggcgacgctgccgaccggcatcaggaataccttgctgccggagaagcccatcacctcggcctcgacctgcaccgggtgatagctgtcgtcgttgatcaccatgcagcgcgtgcccatggccgcccgcaggccttcggcctccagggtcaggccgaccatgcgcagcaggcggccttcgagaatcggctggttcggcagttcggtggcttcggcgtagctgctcaggcgcttgccgaagctggtgcggtcaaggcgcatcggcggggtcctgcgcggggtcgacagggtcgacatccgcggcgggcttgccggtggcggcccccagctcgacgctcaggtccggttcggcgggatgcaaagcctgctcatgaagctggtcggacagcttgtccatgatcttggcgatccgggtttccatggtcgcgtcgatccggctgtgctcggtctcgacccggcagccgcccggcaacatggcttcgtcctcgacgatgcgccagctttcctcatggcgctcgcgcaggcttttgacctgggcgaagtcctgcggattgatgtacaggcgcacattgcccacacccagcggcagcaacttgagggcttcacgcatgacatgttcgatctggctggagtcgatggccagctcgcgctggatcacctggcgtgtcatgtgctgcaccaggttgaccagggctttttcaatctgtgtgtcctgctcggcgatgggctcgaacagattgcccatcagcgtttccagcgcctccagcttggcgctcagggccacttcggcttcctggcggaccttcagcgtggtgctgtggaaaccttccttttcgcccgtggcgaagccttcgttataggcttcctggcgaatgctctcgagctcttcgagggtcagtggctggacttcttccagcggcacttcctcgatctgcgccggcggctcttccaccggctccggctcgggctcgggtacatgggggtcgaaactgggcagcgcccagacgtcgaaaccaccgacgtcccgagcgcgaatcaggtcgctgtgggattcatcactgctggacgacataacgcgaccttagatcatttcttcgccgcccttcccgccgagaacgatttctccggcttcggccatacggcgggcaatggtgaggatttccttctgcgcggtttccacatcgctgacgcgcaccggacccttggcctcgaggtcgtcgcgcagcagttcggcagcccgcttggacatgttcttgaagatcttttccttgacgccttcgtccgaccccttgagggccaggaccagcacatcggaagacacttcgcgcagcaacgcctggatgccgcggtcgtcgacatcggcgaggttgttgaacacgaacatgaggtcttcgatctggccggacaggtcttcgtcgacttcgcggatcgagtccatcagctggccttcgatcgagctgtcgaggaagttcatgatgtcggcagcgcgcttgataccacccagggtggtacgcgaggcattggagttaccagcgaactgcttctcgagaatctggttgagctctttcagggcggccggctgcacggtattgagcgaggaaacccgcaggatgatgtccaggcgcgccttgtggtcgaagttgccaagcacttcgcccgcctggtccggatcgaggtaggccaccacgatcgcctggatctgcgggtgctcgtaacggatcacgtccgccacggcgcgcggttccatccacttcaggctgtccaggccgctggtgttgccgcccagcaggatacggtcgatcaggccgttggccttgtcctcgcccagggcctgggtgagcatcttgcgcacatagtcgtcggagcccacgcccaggctggtctggtcgccgacaatgtcgacgaactcgctcatcacctgctcgacctgctcgcgatgcacgttacccatctgcgccatggccacgcccacgcgctggacctctttgggccccatgtggcgcagcacctgcgcggcgtcggtggaacccagggacagcagcaggatcgcggccttgtcgacccgggtcagtttggcggtagcggctcggttatcactcatctgcgttaatccactctttcacgacctgggccactcgacccgggtcttctgccaccagactcttgattgcattcaactgtgcgtcatagccttcgctcgggctaggcagcaggatgctttgcgggccgccgaggctgacgcgatcgttggccagctcgccatccaggccgcccatgccgccgagttcgacatcgctgccgagccccgccagttgcttgcccttgccgccaccggtgatgttgttgagcaccggacgcagcacaccgaacaccaggaccaggataaacagcacgcccaagacctgcttcacgatgtcccagaaccagggctgcgagtagaacggaatgtcggcgatcacctcgccgcgatcggccgagaacggcacgttgatcacactgacgctgtcgccacggctggcgtcgaagcccacggcgtcctgcaccaggcgggtaaagcgcgccaattcgtcggcgctccacggcgcacggctggtttcgccgttggccggattgaccttgacctgatcgtccaccaccaccgccaccgacagccggttcagacgaccctgctgttgcttggtgtggctgatggagcgatccagctcgaagttcttggtggattgttgacgcttgtcgttcgggtacggcgccagcatcggctggccggtggccgggtccatgatctgctggccgttggcgtccagcagcggttggcctggctgcaccatgccggcggcagcagtggcgccaccggtggtctgcggcgcgctggccggcgatggcggctggttgctcagggcgccaggaacgccttgcgggcccaggctgctggagcgttgttcgttgaccgactgctcgctgcgcaaggccggctggtccgggttgaactgttcggaggtcgactcgacggcgctgaagtccacatcggcggacacttcagccttgtagcggtcgttgccgaggatcggctgcaggatgttgtgcacccgctgggtcagcatgctttccatgcggcggctgtagtcgaattgcttgccggccatggtcagttcggagttttccgcctggtcggagagcaggttgcccttctggtcgaccacggtgatctgcgacttgctcaactcgggaacgctggtcgccaccagattgacgatggccaccacctggcccggctccagcgaacgaccggaatacagctcgaccagtaccgaagcgctgggcttgcgctcgtcgcgcacgaacaccgagcttttcggaatcgccaggtgcacgcgcgcgcccttgacgttgttcaggctggaaatggtccgcgccagctcgccttccaggccgcgacggtaacgggtcgcctccatgaactggctggtgcccaggccctgctctttatcgagaatctcgaaaccgatattgccgtcgcccggagccacgccggcagccgccagcttgaggcgcgcgcgcgacaggtcgtcggccttgaccagcaaggcaccggagttgggctcgacggtgtagggaatgtcggcggaggccagggtgtccatgacctgcttggcgtccatgccggcaaggctgccgtacaacggacggtaatcgggttgctgggaccacaacaccacggcaaaaccaatcgccacgctggcagccagaccgaccatgaggccaacctgacgcaacatggtcatctcggagaggttttccagaaaggacaatcccaacagcggcggcttgccttctgtcggagtggccttggccggtacgttatcggcgactgcttctgccatgactcaatctcgtccttaaaccggcatctgcatgatgtcttggtacgcctgaaccagcttgttgcgcacctgggtcaacgcctggaaggacacactggccttctgcgaggagatcatcacgtcggtcaggtcgacaccgctcttgccgatctcgaaggcactggccagctggctggacgcctgctgagtgtcgttgaccttgttcaccgcctgcccaagcatgtcggaaaaactgctgccgctcacctgcggcaccgcggccgattttggctgggccatggcgtccatttgcatggctcgcatgtccaacatcaaccgattaaattcaataccttggctcatggtctactctctccgacgacccgcaattttttgacactcacgcagcggttagtgaggtgttagcaacaagggtgccagctccgcgcagacaccgaacaaaagcctgcatggctgcatgccttaaacgactcatgttgcaaacagatacgcctcgacatccattccggcatcgcgcatttgcgccaacttgtagcgcaaggttcgcgggctgatacccaggcgctcagccgcctccttgcgtcggccgcgctcggtgcgcaaggtgtcgatgatcatctggaactcccgacgccgcagatcgtcgcccaaggcccccgccgactcggctggcggcacctcggcctccaccggcgcactgcgtaccgtcgccaccgcggcgggtgccatggccggcagcggcgcacaagccagcggtccgcccaggcagaaatcttccggctggatcaggccgccctgctgcaggatcagtgcgcgctggatggcgttgtccagttcgcgcacgttgcccggccatggataaccgagcaggcacgcctgcgcttcggccgacagccgcgcggcagcgtgtttcattttattgacgtgcttggccagcaggcgctcggccagcggcaggatatcggcggtacgctcgcgcagcgggcgccacgccagcgggaataccgacagccgatagtaaaggtcttcccggaaccgccccgcggccacttcgccggccaggtcgcggttggtggtcgccaccacccggatatccagggcgatgggcttgcgcgccccgacccgctcgacttcgcgctcctgcagcacccgcagcagcttggcctgcagggccaggggcatttcggaaatctcgtccagcagcagggtaccgccatcggcctgttcgaacttgccgggctgggcagcgatggcgccggtaaaggcacccttctcgtgaccgaacagcgtggcttcgagcatgttgtccggaatcgctgcgcagttgatggcgataaagggctggctggagcgatgggactgctggtgaatgtaacgcgccaacacctctttgccggtgccggactcgcccgagatcaacacggtggaatcgctgcgagcgacccgcgccgccagttcgagcagttgagcgctggccggctcgaatgccaccggcccttcgccctcggcagccccaaggcaacccagggcatgtcgcgccaccagatccagcagggccttggactcgaagggcttgaccaggtagtcggcggcgccttgacgcatggcctcgaccgcacgctcgaccgcgccatgggcggtcatcagcaataccggcaattgcggctggcgcgcacgcagcaggcccagcaactgatgaccgtccatgcccggcatgttgacgtcgctgaccaccaggctgaacgactcgccagacaccgcctgcagcgcttcctccgcactgccgaccgccttgtagtcatgaccggccaacagcagcgtatccgccagggcttcgcgcagggcgcgatcgtcttcaaccagtagaaccttgattgccattaccttcactccactcctcgagcgccgcagaacagtggcagaaccaccagcgcacatgtaccgcgcccaggacgcgagcgcagcagcaattctccctggtgggcacgcgccaccgccttgacgactgtcagccccaggccggttcccgtggtcttggtggtgaaaaacggctcacccaaacgcgccagcactgcggcgtcgataccgctgccgctatcgctgacgcataaccgcaagctgttgccacgggtataaagatggactttcaggcgcacctgaccggcactggcctggatcgcgttctcgatcaggttgagcaccgcccccaccagcgtgtcgcgactgcacagcaactcgccggtatggctgtcgcactgccagcgcacgggcacgtcctgcacatgggtcagggccgccgcctgcagcgactgcaacaacgccttgggcgtcacgcgatcggtcagcggcaactcgccccgggcaaacaccagcatgtcgcggacctgatgctccagctcatgcaagcgctccttcagccgcccggcaaagcgctgctgggtggcgacaggcagttcctgctcggtcaggtgactggcatacagcagcgcggcggacaatggcgtacgaatctgatgcgccagggacgccaccatgcgccccagggacgacaggcgctcatggcgggccagttgatcttgcaggtgacgggtttcagtcaggtcgttgagcagcaccaattggcccggctcggcatccagcgaacgggtggagatcgacagccgccgcccatccttcagcgaaatctcatgaccgtcgtcttcccgtggcgcgaaacaacgggcgatgacatgccgccagagctcgccctcgagaggcaggcccagcaggtcgcaggcggcagggttggcttcgcggacaatgccctgggcgtcgatgacgatgacgccgccaggcaacagatcgaggaggttttgcagacggttggccagacgctctttttccgccagttcctgcatgcgctgggcgctgaccacggccagttcgcccttgagctcggtcacccgagcctcaagcaggctgtaggagtcggtaagctggctcgacatctggttgaacaaggcgaacgcctgctcaaggccaagccggcttgcctgctctacggacgacgtttgcccctggctttcaggaacaggagacatctgggcggcttggggcatcgtgctctctcgcgtggctgaccgtcagttaaacggaacgttgagagagacttagcaatacccgtgccggaaaaaaaccgcccggttttcaacaggttaaaaaacaggcgtcaatcatccgcctgttcatcaccctcgcgacggctcatgccgtacttgcgcattttttccaccagcgtggtacggcggatacgcagacgctccgcagcccgcgcgacaatgccattggcgtcgtcgagcgcctgctggatcaggccctgctccagtccaccgagatagtccttcaggtccaggccttccggcggcagcatggcggtggcggcgaagtccggcgtatggccattgatcgctacccgctcttccagatcactgcgcaggctgtccaccaactgctcgtcttcgtcatcgacatagcggaatttcttcggcaactcgactacaccgatcacaccgtagggatgcatgatcgccatgcgctccaccaggttggccagctcgcggacgttgcccggccagccatggcggcagagcgacatgatcgccgcggagttgaagcggatcgaaccgcgcttctcatgctccatgcgcgagatcagctcgttcatcagcagcggaatgtcttccacccgctcacgcagcggcgccatctcgatcgggaacacgttcaggcggtagtacaggtcttcgcggaaactgccgacctcgatcatgctctcgaggttcttgtgagtcgcggcgatgatccgcacgtcgacgctctgggtcttgttgctgcccacgcgctcgaaggtacgctcctgcaacacgcgcaacagcttgacctgcatcggcagcggcatatcgccgatttcatcgaggaacagggtgccgccgttggccagttcgaaacgcccggcacggctggtgatggccccagtgaaagcgcccttctcatggccgaacagttcgctctccagcaactcggccggaatcgcaccacagttgacaggcacgaacggcgcttcgcgacgcttggagtgatagtgcaggttacgcgccaccacttccttgccagtcccggactcgccgaggatcagcacactggcatcggtatcggccacttgctgcatcatctgccggacatgctggatcgcccggctggtgccgaccagactgcgaaagaggttgggttcgcgatggcgaccgcgctcgcgggcctgatcgtacatctcacgatagacctgggcgcggtgcagggaatcgagcaacttgctgtagctgggtggcatttccagggtggaaagcactcgacgacgctggtcttccggcaagtcaatggaagaattatcgcccattaacaaaactggaaggaactcatcccaggttgagagtgtctttaacaggcccaaaagtgcaccaggagcatttacagtcccgatgaggacacagattacttcacgactggatgacaatgagccgacagcctgctgccaatcatggctaccgcagggtaaattttcttcgccaagaaaatttaaaatcaccgccaggtcgcggcggcggacgctatcgtcatcaatcagcagaattttggtttcacgccacatgcaatagcaacttccctagtcaactcaatgcccggaatcagggcaagctagacgcttgtaggcattttgagcctgatagacgtctgaaatctgaaaacagccactagttaagtcaaaaaagcgtgcacagtcaaatttatggcgcactggattcggattaacttaggggttaattaaccgaacagatggtaaacctttgccgcgttctgtgcttgatggatctgcgacatctcgtcgactatcgcctgacgctcccctgtcgtcacttcaagaagctgccgataaacccccaacagctcctgcaagttctcgcgcaacgcggcttcatcttccggagcttcactcaagatgtcttccatgcaggaacggcaggccagatccaactgaccgatcgcttcccagttacgctcggccagggcggcgaccagtgcttcacgggtttcttcgatgcgctgcaatacaagactcatggtgatctccttagaactgcggacccggcgcagcgatggcgtcccagccttccttgacggtgcgcagcagatcggcgatctcgtcgagaatctttggatcggtcttgatgttcgcctcggtgaggcgcgtcatcatgtaggtgtacaagccatccagatcgcccagggtgtcgggtgaattttccagatcgagcccttcacgcaagccgccgataatgccgatggccttgctgatgaacacacccttgttgggaatatccttgcgctccatcgcccccttggcctgggcgatacgatccaggccgccttccatcagcatctgcaccagacgatgggggctggcctcggaagtctgcgcctgggcaccaatcttctggtattgccgaagggctaacatcggattcatgttctacctcatcaaaactcaagggttcgtataaccagcgtatcgacctggcgtcaaaaaactttagatcaaaagccaaaagcccggaacgctacaaacgttgccgggcttttggcgcctggtatcaatcagcctttctgttgcgcagtcaacgcctcgaacatcgaggtaatgttgctggcggtggctttcaacttgcccaccagggtgtccatgtcgttgtacttcttggtcagcactgccgtcagggtttcgatacgccggtccagggcctcctgatccaaggtcagcttggccttggtcttgttcagctcagtcgtacgctgatcgagaacaccgccggtctgggcaaaaggcttgatggcattgtccatgcgctccaacaggcccttttcgccggtgaacagggcctgcacctcgccaccgagctttttgtcgttcatcgccgcggtgaacttggtggtgtcgaagtccagggcaccggtcttctggttggtggtaatccccaactgcgccaggacggtcagcttgtcgccagatcccacttcagacagcggcgcacgcatggccgccaggatcgagcgcggcaacgagtcacccgtcaactgggccggaatggtcggcttgccatcatcatccagagacggcttggtcagcgcgctaacgctgttggccaccgcattgtaggcgtcaacgaacttctggatcgaagccttcaagccatcggtgttagccgcgacggtaatggtcgaggtgcccttggcgaccaggttgaaggtcatcccggaaaccgccttgtccaccgagttgctcttgctggtcagcgccatgccatcgacggtgaacttggcatccaccgccagcgcaccaatggaaccagcagaagtggcggtcattggcgagccggaagcgccaacgacattgctgccatcgatttccagaccggcaataccactaagagaaatatcggagcccgcaccggtcgtggtcgaacccaccaccagacgcgatccaaaggagtcggtcacgatgttcgcgctgatacccgcgcccttgagcgatgcgtcggcgttgatcgagtcacgcaccgactgcaaggtagcaccggcttttatatcgaggttgtagtcagtgccattttgactgattttcaaggtaccagtcggaatagcacttgtagtaccgccagcaaaggcagcactggtgactttcgaggaagtcgcaagattctgcacatcgacaacatagctgccattgaccgcagcattgccagcgaccgccgttacatacttgctttcggaagtagtggcggcatagccgggaaattgcggattggtcttgctactgagctcggtaatggtggtccgaaaggtcgacaacaaggacttcaaggtgccgatgccggagatgcttgcggtgttgttcgcagttccccggtcgatctgaccttgcttgggtgctttgtcagcattcaccaaggctttgacgatagcaccggtatcgaggccggagcctagaccggtacccggtagaattggacttgccatggagatctcccttcagtgtgtcgccggtcttttgaccattacaacgcccaaaagaacatagcaacaaatttcatgccagctgtcagactttagcgctgaacaacaggctgctcgcatcattcaaactattggccaacttcaggacttcttcgttggggatctgacggatcacctcaccggagtcactggcaatgaccttgacgacgaccttgccagaaggctcgtcgatcgagaattccaggttacgcttgaccgattgcacaaacttttcaatttcctgaatggccattttcagtttgtcccgctcggtttgcccgcccttactctcttccttgacagtcggcagcgccacaacgtctgcttgaggcttctccacaggcttgtcagcaacagatgctgccggcttggccgctggataagacaagttcagcttcacgctcatatccatgtccatcacctcttaaagtaaaaagcgagagagcacgaccagcgcactcccccgccaaagcttagccagctattactgaagcagtttcagtacagcggacggcagttggttggcctgggccagaactgcggtggaagcttgttgcagagtttgctgcttggtcatctgcgcagtttcagcagcgaagtcggtatcttgtacgcgacccagtgcagcactggcgttttcgttgatgttctgcaggttggagatggtgctggtcagacggttttgtgcagcacccaggtcagcacggctggcgttgatggtcgacagagccttgtcgattgcatcgatcgaagccttggagctggcttcagcggtggcgctgctgttaccggtaatggcgatggcgccggagttgacagccagggtagtagcgtcgaagccggtggccagagcaatggtgatctggttggtagcaccagtgttggaaccgacctggaaggtcatggtgccagcactgccgtcgatcaggttcttgccgttcaggttggtcgactgggcgatacgagtcagctcgtccgacatcgaagcgaattctttgttcagtgcgacacggtcagcggtgccgttcgagtcgtttcgtgcttgaacagccagttcacgcatacgttgcaggatgttggtggattcctgcagagcgccttcagcggtctgagcgatggagataccgtcgttggcgtttttgatcgccatggtctgaccgcggatctgcgaagtcatacgggtagcgatttgcaggccggcggcgtcgtcttttgcgctgttgattttcaggccggaagacaggcgagtcatcgaagtcgacagagcgtcggaagcgcggttcaggttcttctgaacgttcaacgacgtgacgttagtgtttactgttaaagccatgacgaattcctcgttggttgggtactgcggcttccggccctggcaaccgccgggtatggcctagagaaccttcgtaatagttatcgtcggcaatgcaagttgctttaggggattttcaaaaaaatttgccatcagcgtgccacccctcgtaaatcaagggctcggcgttttcaaaccatggaaaaatggcgccaggaaaatgccggagaagacccgggcgcggagatcgcccgggcaggcagggaatgtttcagccagcagagagggaacgcagtacttcaacgcattcgtattgcaggtagtcggccagggccagccagttttgcccttgctgacattcgaacatcaggccaagcaacgtctcccagtcctggcgctgctctggcggcgcggtatcgatcagcggctggatcgcccccatcaactggaccatggtcacggccgtctcgacatcgtgccccaggcgaaagtcctcggcgcattgctgcaagcgggcgatcagcccctcgatcgcgctcattggctgaactccggatggtaggtcgtcccggcaatcatcgccccgtcccgactgctgttatagaagcgcacccgcggatgaccggcgataaaacgctccagctcgcacaggtaactgcggaaattgagttgggtcctgacccgctggccatgcccgtccagcacccagtgccgggccgcgcccagctgcggccccagctcaccgtcgagccagccggcatgcgtcttgttcatcgggaaggcaaagtcggcaccgaacaaggtaacctgctcggcgcccatttttaccgccaggtccaccgcgggatggatcacgctgccgccgacatacagctgcgccttgggcaattgcccgcgcatccgcgtgtaaatcgggctggcggaataccccacgtaacgcggtccctgccagagcgtcagaatctgcggatcgaccatcggcagatagaccagggtgatggctgccgatttttctggtggcaggtgcaggctggaaatgcggtgatcgatgctgaccacgatatccggctcgatcccctgtttgagcaacggccggtaggcggtatcgacacagataaacagaggccgccgggcctgggcgcgaatctcgcgcaagcgttcgaaatgccgctccaggctcggcccggtggcaatcacaaaaatctcgcgccccggctggctaccgaacagctgcgccacgtcactgtcgctggccaccagctcggcactcgcttgcaggcgttggacgacctccggggaatcggccacgaagtcgcggttattgaaggccaggtgcacctcactgaccaggcgatcgcggatcttggcgttgtagtcatccgccagcaccagctcggagggcaaggcgaagaacggcagttggatttctgtcagatcgccggcataactcagttccactcgaggatcgttcaaccaggcctgctgatcgagcaattgcagcaccagcgcaaacaccgcgccgttcaggatgtgcacctgcaagcgttgcagtgccgggttttccagcagtatctgctgcaagtcgcccaagccggtaccgtacagatggatcaccgggctgtcggccggcaggctcgccgcctgggttcgtgcttccgccgtgcgatcgtggcggctggtgagctgaatgccggaaatactcaaggttgaacccaggccttcgaccagatccgcctgcaacccagcactgtcctccgccagcaaccgctcgagcagtcgcggccagcgagcctgtattgcctgggcattgccctcgaagctttcgctcatgctgtctcgcctatcttcatgcaaaaaaatagcgctcagggtacaccctgggcgctatttttggatgccgcgagatcaactcatgggcgatagataattgccgagccccaggacagccctacaccgaagccactcaaggccacacgttgccacttcgactcgagcacgtgcttttccagcagcagcggaatgctcgacgatacagtattaccggtctcgaccatgtccttgatgaacttctccggctcgccttcgaaacggcgcgccacggcatcgacgatcgccgcactgccctggtggatacagaacgcatcgatctgctccgccttcaggccggactcatccagcagctcattcaaatgcgccgggactttcagcagggcaaagttgaacacctggcggccattcatgaaaaacacgccatcggtgactttcaggtgcggagcgccggaaccgtcagtgccgaatttggccttgcccagctgccagggagcgtcttcgcccatccaggtcgcggtcgccgcatcgccgaacagcatggtggtgttgcggtcttgcgggtcgacgatcttcgagtaagggtcggcggtgaccagcaggccgttcttcaggcccgcggcttccatgaagcccttgagcgcgtagatgccatagacataaccggagcagcccagggaaatatcgaaggccgcgacgtgggtcggcaggcccagcttgtcctggacgatggcggcggtgtgcggcaagccttcttcgtcgccgttctgggtgacgacgatcagcgcgtcgatcgactcgcgcgacagttgcgggttgttggcgaacagcgcattgactgcttcgacacacaggtccgaggtttcctgcgtggcgtctttgcgcggcaggaaggccgaaccgatcttgcccaggatgaactcttcatccttctcgaattttgcaccttgtgcgtaattgtctacgccggctacaggcacgtagctcgcaatgctctttatgccaatcattacggcttcccaataataaacagctgaataccccgaccaccggaccggggctgccgacaaacagacatcctggcgcccctgacaggcgacagcgggaagaataaaaggctatcactgcgccgtttaccggccaggcgccatctccccggtcaatacaatacagtgaagatgcgcgttatgactcgcaggtcacgctattttgccgaatcagccatacgaacggctattcgacaaatgcccaatccagtgcggtaccgcgcttgagggcctggcgcgcacaacgcccgaggaccgcgtcgatgtgcttgggggccagccccaggcccggacgaatggccctgacgttatcgctgctgaacacctcccccgccgccatatcgcgggtgacatacagggaacggcggtacaacaccgactgccgctcggcctcggtcgcgccgtaacgcacctggcccagggcctgccaggcacgctcggtttccaccaccaggctgtgcagctccgccggttccagggaaaaactcgcatccaccccgccggcggcgcggtcgagggtgaagtgtttctccaccacagtggcgcccagcgccacggcggccacggaaaccccgacgcccatggagtggtcggacaaaccgacctcgcagccgaacagctggcgcagatggggaatggtcaggatgttgctgtttttcggcgaagccgggtaggtgctggtgcacttgagcagcaccagatccttgcagccagcctcccgggcggcgcgcacgctttcgtccagctcggcgatgctggccatgccggtggaaatgatcatcggcttgccggtggccgccacccgacggatcagcggcaggtcggtgttttcgaaactggcgatcttgtaggccggcacgtcgaggctttcgaggaagtccacggcgctctcatcgaacggcgtggagaacgccagcatccccagttccctggcgcgggcgaagatcggcgcgtgccactgccagggtgtgtgggccttttcatacagggcatacagcgaagagccggcccagagactggccggatccttgatgaagaactcgccatgttccaggtccagggtcatggtatcggcggtataggtctgcaacttcagggcatgggcgccggccttggccgcagcctcgacgatctgcagggcaacgtccagcgactggttatggttgccgctcatctcggcaatgatgaacggcggcgagccggcgccgatcgagcgcgagccgatcttgaaactagtcattggggttttccttcgattcacgcgtaaattcgccagtggccggtccatcaccggcacggcgcaatgggttgccgctcatctcgaacagggccgccgccacccgcgatgcaccctgcccgtccaccaactgccgggagcgctgcgccaggctctggcgcaacggataatcaccaacgagcgccgcgaccgcctggcggatctgctcgacactcacctgctcgctgggccccaggtagacatgcatgcccgcctcggccagcagccgggcattggcctcttgattgccggccacgctgatgcacagggtcggcaggcccagggcggcgcgctcccagctggtgccgccgccggcgccgataaacaggtcggcctcggccatcaagcgggaaaagtcgctgacataggcgtgcaaacgccaatgcccgcgaccggccgccagttcctgcatctgcgcccaggccgggttaccggccccggcgacaaaatccacctgcaggtcgtcgaacgcactcaaggccagcatcgccttgtgggtctggctggccgcatcgaaaccgccgaaattcaccaacacccgactcgctcgctcgcgaatggcgatcggcggacaacggaactcctcgcgcagcaaggcgaagtgcggccccagcaacgcccggcactcggcgtcgatcaggccggcataggcctggggcgtgccgctgaagttctggtcgagcaacaggtcgacctcgtgccgtcggttggccaggtcatcgatggcggcaatccgtggcgcccattgccgcgccgcctgctgccactgccggtcgaggccatagtgatcgaccagcacccaatcgaatcgcggctgatcctgcaacgctgcccgcaaggcgacgatatccgcctgccagggcaagggcgcctcgatgtcctgcgcgcattcacccggataactcgccggcagggcgaacgtctggaaacccagtccggccaggcggtccaatggctgcccgggcaagcttcggcaagcgaaagccactgtggcgccctgctcgcgcaaggccctggccagggtcaggcagcgggcgatatggccgctgccaatggccggcgaggcgtcggcccggatcagcactctcactccagctctccaccggctttcagcgccgcgtacagatactccgcgcgtagccagtcctcctcggtgtcgatgtcctggaccagatggcgcggcaggatcaccggcaggctgagcggggaaaacaccaggtcgccgcgcaaccaggcctcgctgcgcccccaatagaactgcccggcatcctgataggcccgcggcaggtcctgggagcgtgtgttgcgaaactccggataaagcgaagtcaacgcgccctgctcgtccagggtcagggcgcgctgcaccggaaacgcaaagctgcacacggaaaaggcgaaggacttttcaggatgggcctccagcgccgccaagccctggcgcaggtagcgcagttgcaacaagggcgcggtggcgtaaatgcagcaggtgtaatcgaaggtctcgccacgcccctgcaatgcctgcaaagcatgcacgatcaccggcccggtgccggtgaaatcgtccgccagttcggccggacgcataaatggcaccgtggcgccgctggccctggccagctcggcgatctccgggtcgtcggtactgaccagcacctgatcgaacaacccggagcgcagcgccgtggcaatcgagcgggcaatcatcggcacgccgtcgaacggcttgaggttcttgcgcgctatacgtttgctgccgccacgggcgggaatgatcgcgatggcactcaaggctgggcgggctcctggataagctggcgcaattgctcgaccacatacgtctgctgctcatcgtccagcgccggaaacagcggcaggctgatggcttcgccgtagtagcgctcggcctcggggaaatcccccgcggcgaatcccaggtcgcggtaatacggctgcagatgcaccgggatgtaatgcagattgaccccgaccccggcctcgcgcaatgcctcgaacacctcgcgatgggtgcggcggatgcgctcgggctgcaggcgcaccacgtacagatgccaggccgactgcgcctgctcctgagcctgcggcagggtcagcggcagatcggccagcaggcggtcataacgagccgccagttgccggcgccgggcaatgaaagcgtcgagcttgtccagctgggacaagcccagggccgcctgcagatcggtgatgcggtaattgaaacccagctcggtctgctggtagtaccaggggccgtggctgggctcggtcatttgcgccgggtcgcgggtcatgccgtggctgcgtaagcggcgcagatggtccgccagttgcgggctgttggtcaggaccatgccgccctcggcgctggtgatgattttcaccggatgaaagctgaacaccgtcatcgccgcgaattcgccgcagcccaccggccgcccggcataggacgcgcccaccgcgtgggaggcatcctcgatcagcacgaagccataacgctgcgccagttgcgccatggcgcgcatgtcgcagctttgcccggaaaacgccaccgccaccaccaccttgggcaatctgcccatgcgctcggcggcctcgagcttgtgcgccaacgcccgggcatccatgttccaggtgtgcgggtcgatatcgacgaagtccacttcggcgccgcaataacgtccgcagttggccgaggcgaggaaggtattgggcgtggtccacagccggtctcccggccccaggccggcggccaggcaggcgatgtgcaaggccgccgtggcattgcacaccgccacgccatggccggcctcgcagcgagcggccatggcctgctcgaagcgttcgatggtcggcccctgggtcagccagtcggaccgcagcaccgcgaccaccgcatcgatgtccgcctggtcgagactctggcgcccgtagggaatcatgccggcaacctggcatgcagctcggcgatctggcccaccgagaggaaatgcggattggtgtcggagcggtattcgaacgcctcgcccaccggccgcccctgttcgcccaggccgtccacggcaaagtcgacgttgacgttggtaaagcggatcgacggctggatggtgtagtgatcagtgaactccagggtcatgcgcgcgtcatccagcggcaccatcagctcgtggagtttttcccccggacgaatgcccacctgcttgtgcggcaggttttgcgccatgccgcgcgccaggtcgacgatccggatcgacggaatcttcggcacaaaaacctctccgccatgcatgcgcgagaagctgtcgagcacgaactgcaccccgtgatccagggtgatccagaaacgggtcatgcgcgcgtcggtgatcggcaactcgcgggcgccttcggcgatcagctggctgaaaaacggcaccaccgaaccccgggagccggccacgttgccgtagcgcaccacggcaaaacgggtcggctggtcgccggcgatattgttcgccgcgacgaacaatttgtccgacagcagcttggtcgcgccgtacaggttgaccgggctcgccgctttgtcggtggacagggcgatgactttcttcacgccgttgtcgatggccgcggcgatgatgttttccgcgccgttgacgttggtgcggatgcactcggtggggttgtattccgccgccggcacctgcttcagggccgcagcgtgcaccacatagtcgatcccgcgcatggcctggcgcagacgctcggcgtcacgcacgtcgccgagaaaataacgcatgcagggcgcattgaaggtctgctgcatttcgtactgtttcagttcatcgcgggagaacaccaccacccgcttgggctggtattgctccagcaggcgccggatgaaattgcgcccgaacgagccggtgccgccagagatgaaaatcgatttgccgttgaacatgtcttgagtcctttttcctgtcagccaggcttatgcgagcagttgcgcccagtcgacactggcaggagcgccaggagtgaagcccttgccggtccggctcaggttctggttgtaagttacatcgtgttcgaagcgcgcctgccatttgtcacgcagcgccgccgcgacctgggtatcgtccgccaggatgccgggatggaggatctgcacctgcggggtccagaccgtcaacagcccggcatcggccactttcaggcacaggtcgacatcagcgaatgcctcggcgaagtgttcttcgtccaggccaccgacggcgttgtagacgtccttgcgaatcatcaggcaggcgccggagaccgccgaatagtcctgctcggcgagcaagccgttcaggtagccgctggcgcctttcggctcaccggcgaacgccgcccccagatgcccgttcaacccgagaaccaggccagccgaggtggtcgcgcccttggcgtcgaccaggcgcgcgccgacaatccccacctccggccgctgcgcctgattgagcaggctctccatccagtcggcattgactacttcgccgtcggccgccagcagcaccaggtactcgccgtgggcctcctggctcgccgcgttgtacagcgccgaggcgctcaggcgccgcgggctgcgcagcacgcggatacgatcgcccttctgctccaggctggcgagccagctggccaactcttcggactggctatggttgtcggcgatgaccacttcgtagcgctggtagcgcgtgcgttgcagcacgctgaccaggcaacgctgcagctgctccaggttatcctcgctgcgcaggatgatcgaggccagcggacgctcggcatggccgtagttgatctggtagaccccaggctgcgtcgcgctgacctgggcccggtagccacggttgcccagatggcgggtcaacgcctggctttgttgggtgttctcctccacctccgcggcctggccgatcaacagcggctcggccagatgggccaggccggccagcccgccgtcttcgatcaggcgcagcagcaggtcgtattccatggcctgtggaaaggctgtcgaatagccgccggcagccgccagcacatcccggcgaatcagccagtggccagccatcaggtccggcacgctttgcagcaggtcgaggttgacgcccgggcggaacacatccttcagcgcgccatcggcgccgtagtggatttcgtccatggccaccgcgcggcaaccttcggcaccgagcagttccaggctggcgcgcagcaggccgctggcggtaaaacgctcgccggcacgggccagaagcaaccagtcacgggaggattgcgccgcgacctggttgatgcgctccacatagttgctggtgctgaccttgacgaaatgcacggtgtcctgggcggtggtggtcgccggcaggtcgcccgtggtgaagaccaccacctggaaagaccggcaatggccgttgaccaggctgtcgaaggtcgcctgcagcttgaccatgtccgcgtcgaggtcgagcagcaggatgccgaagctcgggccaccgttgtgccgggccaggtgctcgttgatcgccttgagctgctgcgcctcggggttgcgcgcctccagccacttcagcaggcgccccgaaggcatgttctccagcagccccgggctgtcctgaaaaggcagcgacgccaagcgctcggcccaggcctgcaatttgcgggcatcgttctgctcctgagggtcctgcccctcgcaagcctgcagcgaggccgccagacgctggaccacctcaaggttgaacaggttgcacgacagcgcctcccacaggcggctgcgcagggtacgctcggtgtcgttgggttgtacctgcatcaactcccgctgcttgagcagcacgccttcgagctcctgcagttgcaggcggccggccagcatcccatgcatgaggaattcgaattcggtcaacaggtcgaacatcggcttgttgtagaacggcatctcgacgaactgttccgggccgaacgaacgcaccggctcggcccccggctcgagccaggccgaacgaaaaatcatcttgccgttgagcgagcgcccgctgagcaggcactcggccatggccgtgaagctgtccagggcaatctgtttggcccgctgtgggtccaggccgctcaagccggtgggcaacgacgccaggaagccggcgaatgcctcgcgctgggccaccgacttggcgtcgccgtaggtcagcaccgtcaacacatcggtgttgtgctccgaggcgttgtagttgacttcgcgcacggcgaacgggatcggcaggatccgcgccttggccgaggccagcaggaagaaggtgtggccgatttcctgccattcgaaactggtccccggcggcagcaggctgtaccactgttgcagcaggtcggtgcgggtcaccgcgtagaacggcggcaggaaatggctcatgaacgccatgacccgctcgccggcatctgccgaggcgtagtcctcgatcacccggcaatcgcgccggtagtagttcacctcggcggcgcgggccaggtacatcatcccgtagccatggcacaggccgtagtcggggttggcttcgagaaactccaccgactcggtcagcgcgccatggagcaggaagtcgtcgtcggcggcaaataccatgtacggcgtggtcacctgcccgacaccgtaggtgagcttgtcctgcaggcccttgtaggtgtactgcggcagatgccggtagtcgacctgggggaactgcccggccaggctttcgtcggcgtgctgcgaagagtccagcaccaggatcttgcaggggtaggtgctgtagtactgcaaggtgcggcgcaagaacgccttgcgattgtgggacatcaccaccagcgtgaaacgctcgctcaacggtgcgctagtgttttgagccttgtcttgaacctgcatcagtgtttccccacaaccggcaaagtgctgttacctgcaaaccattgaattcaacgaacgcgacgcagatagccatccggcgccacggtgatcagcagcttgttctgcatctggtagtcgatctcgaagtcgcggttctcttccagataggcccagaccgcggttttcgggttgtcgcccgggccccatgggcggtccgggaagaagtccgccggcatgtcctcgaccacggtgtccatcaccacgcagtagctgtccaccgacaccagcggcgcgtacaaacgcagctcctcgagcacgtgctcgtgggtgtggttggagtccaggaccaggatgactttcttgcccgcggccgccgcgcgcacctgctcggcaatcgccggatcgatgctcgagccctcgatcatctggatgcgcttgctcatcggatggctttcgatggcttcgcggttatgcgcgcggatatccaggtcgatgcccagcacttcgccgtggccctgcagttcgagcagcgaggcgtagtagatgatcgagccgccgtgggcgatgccgcattcgatcaccaggtccggcttgacccgccagatgatctcctgcatggccatcatgtcctggggcagttggatgatcgggcggcccatccaggagaagtgatagctgtacttgtggccggcggactcgttgaagaagtcgcgcgccaggcccttgagtttctggtcttcgccctgggcgcggatctgctcctgacactcggcttcgaaggcttggatgatgctgttgtcggtcatggtcgggtctcaataaacgtcatttgaaccaagcgctgtcgaccgcgtgatagacataacgcccatcggtcatgcgcttgatttcgtcgagatagttggaattcatcacaaacagctgggcgccctcgggcaaggtcgccatggcctcttcgggggacgacacacgggcgccgctcaggggcaggtaacggccctgcttggccggattgatatccaccacctggtccaccgaaacgcccgcgcgctgcaggaacagcgaatagatcacacccttggaagacgcgccccagatcgccgagcccgcctcgggttgggcctggatgatctgcttggcgcgctcgaggctggcggtgaaatccagcggcatctccaggcgctcgaccggtgtctcgccgggctcgcgcaaggtgccgaggtcggccaccacgtacaggtactggccgccgaacaggtggccggcttcgtgcacgctgccgaacatccggcgcaggtcgtccaggcggaagtagttgacgtgctcgtagaacacgtcgaaccaggcgcgatgctcgacgatccagtcgaagcacggcacctcgatgtagatctgcccgccccggttggcctcggccatctgtgccaggaacgcccgcgggtcggcgatatgctccagcacatggcgcaacaccacggcatcggccgacaggcccaggccagaggtaaagggcgccttgatcacatcggcgttatcgccttcgtaggccgggtcgatgccggtgatgcggtagccccgctcacgcagcagctcaaggaaatagcccttgccgcaaccgacctcgatcagctcgcggcccttgaaatgccgggcgatgatgccctcgacatccagcaggtgacgctggaactgcgccgagtgggcctgctcgttctggtagtcgctgtcgtagttcagcttgtcggggtcgaaggcctggttgaagatcaggccgctctcctcgtcctgcaccagcaccatgtcggcacaggccgacgccctggcgctctgcgcgtcggcgaaggtgcgattctgcagcaccggcaggtccatgacccgatacaactcatgccccatgttcggctcccaatagttgttgcaggcgctggttcgccccccagaacgccatgggttcgtgggcgggataggggtaatgcccaagattcaggcggatcatcgagccacgctcgcgcacccgtcgctcgaccagcgcacgaaccgatatcggctggccgctggaacagttgaccaccccggaaaattcccgccgttgcagcaacgccgccaggctggcggcggcgtcttcgatggccaggtaatcgcgcagctgttcgccggcggacatgtcgaacaccgcatcgccggcgtcgatcgcccggtccagggcggccagcaggctgttggggttctgcccggcgccatgcaggtagaacagccgcgcccattgcagggtgaacggcagttgctgctgcaggttttccaggaacagccgcaggttgtgcttggccaacccatagggattgctcggctgcgccggcgtctgctcgtcgagcggaccgctctgcataccgtattcgaaacaagtaccggtgatcatgacctggggcacgcccgcctcgaccgcggccttgatgaaccggtagtcggccatcaggttgtgctcgaagtggaacagcgccttgtaattcggcagccccggccaggccaggtgcgccagggcatcgacgccctcgaccagggcggcgatatcggtgtcggcggcatgcacgtccgcggccacccgctccaccgctccagcccagggcatggcggccagcttttgtgggtcgcgggccagcgcccgcacctggcagccgcgggccagcaaggcggcgaccagatgccggccgacaaacccgctggccccggtgaccagtaccttcaggccactcacagcagcttcgaactcgggcacggcgatcacgaaacgcccgccccactggcgaacgtgggccagttgctcgctgacttccgacagcaggttccacggcagcaccagcacatagtccgggcgctcgctgtcgatacgctcgggcgcgaccaccgcaatcctgctgccgggcaggaacttgccctgcttgtgcgggctggcgtcggcgacccaggccagcaggtccggcttgatcccggcgtaattgagcaaggtgttgcccttggccgcggcgccgtaacccaccacgcgcttgccttcggccttggcctggagcaggaagcgcagcagctcatgcttgatccgctcggcggccggcgccagggtcgcgtaatactccgaggtcttgaccccggcttgttgctcgagccgcaactgctgttgcaccgccgcctgcacctcgcggcgcggaccatcgctgcgctgtacgaagacccgcaacgaaccgccatgggtcggcagctggcagacgtcgaagacttccaggccgttgcgctcgcacagcgtctgcaccgcggtcagcgacaggtaggaatagtgttcgtgatagagcgtgtcgaactgcgcgccggccatcagcgtcagcagttgcgggaattcgaaggtggccacgccggtcggcttgagcagcgtcgcgaaaccgccaaggaaatcgttgatgtccggcacatgggccagcacattgttggcggccatcaggtcggcggcccagccttggtttttcaactgcgcggcggtgtcgcgaccgaagaacagctcacgaatctccaggcctttttcccgcgcggcttgcgcggtgctgcgggtcggctcgacgcccaggcatttgatcccgcgagcggccacgtactgcaacaggtaaccgtcgttggcggcgacttccaccacacggctgtcagccgtcaagccaaagcgctcgaccatctcggccacatagcgctcggcgtgggccagccaagtgctggagaacgaactgaagtaggcgtactcggcatcgaacaggctttcggcgctggtgtaatcctcggtctgtaccagccagcattgctggcacacggcgaccttcagcggcacccactgctcggcctgttcaagacgctcggcatgcacataggcattggacggtggcgaggtgccgaggtcgatcaacggcaggctcagcggcgcgacgcacccacggcagttcatagacgcactccagcaaagtgttgatcgagcgcgggatggctggaatcccgggccgacagattattgacaggcaacggccaggcaatcgccagccgtggatcattcaccgacagaccgccctcgtgctccggcgtgtaatcggcgctgtgcaggtagagcaactcggcgtcgtcggtgagggtctgaaaaccgtgggcgaatccggccgggatcagcaggctacggccatcgccggccttcaagtgctcggcgtgccagtgcagaaaggtttcggagtccggacgcagatccaccgccacatcccacacctcgccgcgcaggcaggtaatcagcttggcttccggcgccttggcgttctggtaatgcagaccacgcacactgcccttctcgcgggtacaggaatggttgatctggcggatatgaaactcgctgccgaatgcactcagactgccttcgcagaacagccgggcgaagtgtccgcgctgatcttcgaagcgtttgtgctggacgctgaacagcccggccagcggcagctgtttcaaggaaaactcgctcacagcgcgccccggtacaggttcagttgagcgagggtcacagcgcgcatatcgtcgccacgctgccaggccagatgccagtccagggtctgcgccaggcattgctgcagcgaccaacgcggttgccaggccagcagctggcgtgcgcggctgctgtccaggcgcaacaggccggcttcgtgcagctcgctcggttcgatccgcagcccgggggcggccggccagcgcgcggccagcaactcgaccacttcgccgacgctgcacatgtccgcttcgcttggcccgaagttccaggccccggcgaaccgcggcccttgttcgtagaggccggcggccagttgcaggtagccggccagtggctccagggcgtgctgccatgggcgcaccgcctgcggataacgcagggttaccggctcgtcggccgaccaggccttgagcacatcggggatcaaccgttcaggagcaaagtcgccaccgcccaacacgttgccggcgcgcgccgtggccagggccaggccatgctcggcatgacgctcgaccgggaagaatgaagcggcataggactgcgccagcaactcgcagcacgctttgctgctgctgtaggggtcatgcccgcccagggcttcgttttcacggtacggccacagccattcctggttggcgtagaccttgtcggtggtcaccagcacgcaggcacgcacgccgccgacctgacggatcgcttccagcaggttgagggtgcccatcacgttgctggagtaagtacccagcgggtcgcgatagccttcgcgcaccagcggctgcgccgccaggtgcaggacgatttccggctgcgtctcggcgatcagctccagcaaggcgccaaggtcgcgtaggtcgccgcgctggtcgttgataccctcggcgacccgcgccagctcgaacaggctcggctcggtcgcagggtccagggagaagccactgacttcggcccccaggctgtgcagccacagggtcagccagctgcccttgaaaccggtgtggccggtcagcaaaacccgcttgccacgccagaattgcgcgctcaggcccattgcttccatggggcctccccgctctgccagagttgctcaaggtggttcttgtcacgcagggtgtccatcggatgccagaagccgtcgtgctggaaggcgtgcaattggccttgccgggccagggtggtcagcgggccggcttcccacactgtgtcgtcggccgtcagcagcggcaacaccttgggcgacaagacaaagaagccgccattgatccagccaccgtcaccgcggggcttttcggtaaagcccaggacgctgtcgccgtcgcgctccagggcgccgtaacgaccgggcggctgcaccgccgtgacggtcgcgtgcttgccatgggccaggtggaagtccaccagggcgccgatattcaggtcggaaacgccgtcgccgtaggtaaagcagaaggcttcttcgttctccaggtagcgtccggcccggcgcagacggccgccggtcatggtttcctcaccggtgtcgatcagggtcacgcgccagggctcgctgtagttctggtgaacgtccatgcggttttcccgcatgtcgaaggtgacgtcggaggtgtgcaagaagtagttggcgaagaagtccttgatcgcgtaccccttgtagcccaggcagatcacgaagtcgtgaatgccgtgggccgagtactgcttcatgatgtgccagagaattggcttgccgccgatctcgatcatcggcttgggcttgagatgggactcttcgctgatgcgcgtgcccaggccacccgccaaaataactgccttcatcgtctcccctcttgttcctcacagggccctgccaagctgcagcgagctttttgcggaccttctggataaaaccttgtgccgttggcggcgccttcctttcagcggaaacgctcgttttatggcgatatcaaggggggcttgcaggaaacgcgccagctcctcgcggggctgacgcatgacctcggcgtcgcgaatcagagcgggcaacgcaacggatcgtaggcttgagcagcaaaaaaaccgggataaccgccataaaaaagccaggcatcgaaagcctggcttttttgtccccgcaaaccctgtcagtccggcaaccagcccttcatccacagattcaggttattgccccgcaacatgtaatcgcgcagcacgtgctcgcgcagcgcatcgcccatgcggtagctggcagcgggatcggccaggtgcatgcggatcgcttcgatccattcccgggtgctgttgctgacgaccttggtacacggcaggtagccgcgataggccgcggtgtcggtgcagatcaccggataaccgcaagcaccgtattccaggagccgcaggttgctcttgcagtcgttgaagatgtggaactccagcggcgccagggccaggtcgaggttgaggctggccagcctgtacgggtaagcctgcaggctgatcaaggcgtggaactcgtggacatacggccgcagttcgtccgggcacatgccgaagaacacccattcgacttcattggccagttcgcgcaccacctcggcgatgacttccaggtcgccggtgtggctggtcccccctccccagcccacccgcggcttgcttgaagtaccacggcggctggtcaggctgccccaggggtcgaccggcagcatgttcggcacgatccggatgtcgctgtgcatgcccgacagcgcatcggccagcggctgggtggtgaccaccacccggtcgcacagggcgatgccctggcgcagcagggcttcggtgttgagcggtatgttgcgcgcgtggctgtttttcttcggcgcactgaccacgtagtcgtccagctcgaagacccgcagggcactggagtactttttcatgcgctggatatcgctcaccgcgccgtcgctgtagcggcactgcaagatgatcgagtcgggggacaagcgctcgatttccacgttcgccggggactcgtgggccactcggccgatcagccgtccctcctcttccagcgccgtcagcggcgcgatcacccggtaatgccccaccgccatgttgttcaccggcaagccgagcaccagcggcaaggcccgggtcgagaacggattccagttatcgcgcaaccccacttccaggctgaagctggaataacccaggctcagggccgggttgtaggccgggtcacgggcgacctgaggcatccagctacggtagaacgtgtcttcctgcgcctccagcgcttcgggctccgctggcgccgtctcggccggcatcaacaccaggctggcatgaggcgtccagaccaccaggtaaccgtcgcgattgatccgcaggcacaggtcgacatcactcaggccctgggaatagttgacctcatccagcccgccgacactgtcgaatacctccttgcgcaccagcaggcagtcgccgctgaccgcgctccagctctgcggcacttgcaagcgctgcatgtaaccgcgggcgctggcggcctcgccatggaacggcgaactggcggctccagccaggccgaggatcaacccggcgtgcacgatcgagccgtccggcccgagtattcgcgcgcccaccacccccacctccgggcgccgggcgtggttgagcagttcgtccagccagtcgccggagcagatcaaggcattggcgtcgagcaacagcaggtattcgccgcgcgcctgttgcgccgcgtaattacggaccgccgccgcagtgccgcggccggcaaacggcaacacccgcaacatgtcggcaccgagctgcgccatggcctccagccacgcggccatggccgggtcgcggctgccgctgtcgacgatcaggatctcgtaatggctgtaggcggtcttttcgatcaggctttcggtgcagcgctgcaaagccgccagtgaatcgccagcctggatgatgatcgacacctgcggccgctgcgggaacaggtagtcgatgtggttgagcagcggcaattcgtcgtggcggatgcggtgctccacgccgattctgtccagatgcgcaccgaccaggccggcgttgccctcgatcactgcgggcagcgacagccagtcggcgaaattgaacgggctctcgacctggatttctgcaatatgttcgatggtctgcggccccgcctcttccaccaggcgccacagcaggtcatgaggggccagctcgccgaaggccggatcgaaaccgcccagagccagaaagcgctggcgctcgaatgccagcgtccggccgacgtaggggtaaccgcgcatcaggtcgaggttgaaatcaggcttgaacaccgggtcgctggactcgcctttgaccagcgcgccttcgtcgctgtagacgcacagcgcgcccgggctcgcggcaatgcgttcggcaaggatcagcagcgccgattccttcaaggtgtcacccgcgcgcagcaagtaaaaccagtggcaaccttccagctgcggcaccagcgcattgagctgctgtggccactgtgcctccagcggcagttgcagcacgcgttcgtgttccgcgcactcggtattggacaggaccaggatcgcctgcggcgcatacagctgccgcgccaggctctgcagggtcgactccagggccacgctatcggcgtccacgtcgatcacgacgggcacgatctgcggccgtgtcggccagctggcgatgcgctgtggcaggtggcgtttctcggtgtcggtaaaacgccggatcgccagccactccttgtagaactcggcgtaactttcactctcgccgccgacccggccattgaccaccgtactgcggttgcccagtacccgggtcacgcacagctcgtcccactgccagccgggctgcgccatgctctcgaggtccacatagcgtacccagccctcggccggggccgactcgccgctgcgcgcagcgagcatctgcgccagccagtcccattcaagtttcgccacgcgctgcacttgcggctgcttgctcagacgctccgggtacaggcgctcggtgctcagcacagtattgagcagcgccaggttgccacgccgcatcaggcacacgaacagcgccagatccaacagcgcgaggaaacccgcgccctcttgcgtcagggctggcaacagctccagcacgtcgacacggcgcatcagggtcgaactgaaattaccgaggaagtggcgcggcgtgctctcgaggatcgccagcatgtcgtcgcccttgagcatcgcgtcgttcggcgacagccgggcattctcgacccgcggcggcagaatgaaattgccggcgtcgctcaacacccgcaaaccgcagaccagattgatctcggggtgatcggccagcacctgcgcctgcatggcaatgcagggagcgaacagacggtcatcgtcgcagaggatcttgatcagttcgccccgcgcctcttcgacacagcgcagcaggtttttctgcatgcccaggcactgcgggttgcgcagataacgcaccggatggggcggctcggcgatggcctcgaccgcctgacggatctcatcgccagccgagtcgtcgcagatgacgatttcgatccgctcccaggtctgggccagcgcactctcgaacgcctggctgaagaagcgcggattgaaggcagggatgacgatgctgactagcgggcgttgattcacgacgggaaactctcgagcggcgggcccggcctggtcaggcgggccgcggaaccgcttaatgaagacggttggcggctcggcggtgcggccgcgctcacaggagcgcgaccgggctcaggctcagaccttgttgaacaggcccagctgggtaatcttgctgaaggccagttgcgaggcttgcagcatggtctgttgcagggtcaggcgggtcaacacctcggccgggtcggaatcgcggattgccgactgggtctgggtattggcggcgctcaggctcaggttggtctcgttctggatatccagcgccgacccacgaccaccgatatcactgaccgcgctcgccacctggttggcgccgctggccaggttggccatccccgcctgcaaccccgcgttgagtttctggatggcgatcggatcaccgttggtcggtgtatccagcaccgtacgcagttggctgatggtgtcgaggacgttctgggtctggtggttgttgaccgccaccacatactggtcgcccgccgccggcgtaccgctgaaggtgaagcccacgccagacgccgtggcagtggagccggccatggtgccggtggagaccggcttgctgtcggcggtcaacggcgacgcatacagctcgtagtcggtggcgctggtgaacttgaggatcgcaccaccgctcgggaagctggcgttgtaggcgttgctgttgctgacgctggcaccggtcaccaccgcggtcgacgggttgcccgggctgcgcgagacgttgaaggagtcaggcttggccgccagggtgaagctgtgaccggcaatctccgtgttcgggggggtggcatcgccgggtttcaggttgatgctcaggcgcagatcgacgccacggaaactgacggtctgtgcctcggcgcccttgctggagctgaaggagccattctggctggcctcggacgtcacgtcgttgccggcgctgtcggtgatcttgaactgagtgctgctgaggaagctgatggtgtacggctcgccgctgcggaactcgctgttgtacttcggattcgaagacacctggccgttggacagcgtcacccggccatcatccaccgccggggcggtcatgctgacctggctgcggctggtgttgatggcttgctggaaggcggcccagccggtggtattggtggccatggacatggtgtcgcccaccggcaggttcagcgtggtctggtcgccgttgtagctgtaggtgccgtcggagttgcgggtgaacggcacggtgtcgccctgggaaccggcaaagatgtacttgccgttttcatcctgggtattcatcaggctcaacagctgctcttcgatctgcgccagctcggcggcgttggccttgcggtcggcgtcggtgtaaccggcgctgcccgcgccggtcgccagttcctgggcacgcgccagaacgttggtgatgctggtcaggaccgattcggcctggcccagggacgccttgatcgaggtggtgttggccgagtactggctcaacagcgaagcctgctggcccagttgcagcaggcgcgaggcgcctaccggatcatcggccgcggtgttgacgcgaaccaggctgctggcctcttcgctgctcttgaccgcattggcgaagttcttctggtagttggcagccgaggactcgtaaaactgggcggtggaaatacgcatggactacgactccttaaaggctgttgatcagggtggcgaaggtttcctgcgccgccttgatgatctgcgaggacgcggtgtagtactgctggtacttgaccaggttgccggtctcttgatccaggtcgaccccggacaacgaatcccgcgcgcccttggcgttggccaggatcgtctcggtggccgcgctgtcgagcttgccctggctggccttggcaccgacgttctccaccagcttgccgtaggcgtcgaccagggtgatgcccttgctggccgaaccggtatccaccgtctgcttgctctgcaggcccgccagggcggtaccgttgcggttgtcggtggaaccggcaccgttgaacttgacgttcagcccttcgccttccttcggcgagccggcgacgctcatttccacggtgaaagttttctgcaccggcggtgtgccgccgtcggtgatcgggttgccgctggcatcgaccatcttgatctgcaggttcagggtgttgttctgccccggaacaatcgaaccggtgcccatcaacgtgcccttggcatcgtagtacttgtagccctggctaccgcccgcgggggcgtcgaagaccagcttgaccggtaccgagttcttgatcgcggtctgcatctcggttttggcggccgagttgtagatgtccagcgccggcttgactgtcggcaggcccggaatgctcagcgaaccggtggcccccggcagcacctcggcattcagcggcgcggcgatggccaaacgcttggcgtcggtcagctcggtcttgatagtggtcgccgcgttacgggtcggggtgatcttgaaactgtcgccggcactcatcgccccgccgttgaggctcagggtgaaaccgtcgatcaccggtggcggcgtggtggtggtgctgaacgcgcccaggctggtgccgtcggagcgtttgaccgtgtagtcggtggcgctggtgaaggtcacctggtagtcgctgatggtcagcttgccggtgtccttgatggttacgtcgaggttgcccgagcctgcgctgttgttgccgttggcaatgctgcgctggctgatcagggccgcgctgttgatgttgttgaacagcgccgcgccgaactcgccgttcttgtcgatgccttgtccgagctggctgttgacctggtcggcgatcaccagggccacgcgccccagttcgttcatcgccgggtccagcacctcgttgcgatagcgcagcaggccgccgatctcgccaccggtgaccaccgaggtcacatcgatagtgctcgagccgcgattgagcagcagcgaggaacgggtcgggtcggtcttgccggcaaccacttccagcttgctggaggtgttgcccacgaccagcggctggccgctgcccaggtacaggtcgacgctggagccgcgctccgagacatccactttgacgaaggtcgacagctggcgcagcgtctcgttgcgcgcgtcgagcaggtcgttgggcatgccgccgccgctggagacttcggaaatcttctggttcagctgggcgacagtggccgccagcttgttgacctggtcagccatgctgctcaggttgccgttgatattggcgttctgctcgttcaactggctggaaaccgagttgaagcggttgctcaaggcttgcgcatcgctgagcagcaattggcgcgaagcatcgtcagccggcttggcgttgacgttctgcatcgaggcaaagaacttggtcagcgcgccggtgatgccggtgccgctgtccgacagcaacttgtccaccggggtgatctgccccagataggcagcggcatcgctgttcagcgaggtggtggtctgcagctgggcgtccagatagctgttgtacacccggcgcacgtcggccagggtggtaccgctgccgatgaagacattgccgtactggttcgaagccttgctgccctgcacggtctgctggcgcgaataaccggcggtatcggcgttggcgatgttgttacccgtggtcatcaacgacgtttggctggctgacagccccgacatcccgatattgagcaaactcatgattcagaccttataaattcgtggaagcgcccgccgcagcgtagttctcgtagctcttcatctgcttggcaatctgcgaaatcttgcttgcgtagtccgggtcggttgcatacccggccttttgcaactcgcgtacaaactgttctgggttatcggccgacttcagcacttcttgatagcgattgttgctctgcaacaaggtcaccaggtcgtggaagctgtcctgatacgaggcataggaacggaactcggccgtctccttgaccatctggccatttctgaattcgctggtgatcgcccgcgcctggtcgcccttccaactgctgccggccttgataccgaacaggttgtgactgctgctgccgtcctgctggcgcatcaccgatttgccccagccggtttccagcgcggcctgggccaccaggtagcgcggatcgaccccgatgcggtcggcggcctgctgcgccatcggcagcatggtggcgacgaattcgtccgccgagctgaaggctttcttcgccggcgccaacggtggctgggccacggcacgaccgtagatctgcatgcgtccgtggggcaccgcggcaaaactgcgcgagctgttcttgaccagcgcgtcggtagcggccgtggtgcgttccggcaaggccgtcctgttgacggcggcgctgtcggccgacggcacgatgcccgccagcaggcgatcggtcagcttgctcggcagggaaatacgccgctggttgagcagcgccatatcgttatgggtaccgctgtcggcggcgcgctgcggttccagcgcacgagacgcccacaacggacgctggccattgacccgcgacaacggcccgcccaaagcggtggtgccggcagcgatggcggttggcgtcgcgaccttttcagtcagcgcgaccttttcggtctgggcgccaggcaaggtcgccgccgcggcaggattagtggatttgttcttcgacatctggcgcatcagcacatcggccaggccgatgccaccgccctcgcgggacatggaaaccgccagttgctggtcgtacatttcctggtattgcttggccgccggagtgttaagcgggttgtccttgcccagcgcttcggtggccgagcgcatggacttgagcatttcgttgaggaacagcgactcgaactcctgcgccaccttgcgcatgttggcgtcgctgttcttgtcgccgaccttgagctggttaagccggttgaggtccgagtaggaacccgaatcgccgctgctgaccaggccgctcttgcgaatatccatggcccctacctcaaatcacgatcaggtcggcttgcagcgcgccggcctgtttcaaggcttcgaggatcgccatcaggtcgcccggtgccgcgccgacctggttcaccgcacgcacgatctcgtcgagggtggtgcccgggccgaacttgaacatcggcttggcttcctgctcggcgttgacccgcgagcgtggcacgaccgcggtctggccgttggacagcggacccggctggctgacgatcgggtcttcggtgatggtcacggtgaggctgccgtgggtcacggcggctggcgacaccttgacgttctggccgatgacgatggtgccggtacgcgagttgatgatgaccttggccaccgcctgccccggatcgatttccaggttctcgaggatcgacagatagtcaacgcgctggctcggatcgagtggcgcggtaacgcggatcgaacccccgtcgatggcctgggccacgcccgggccgagcatgtcgttgatcttgtcgacgatgcgcttggcggtggtgaagtcggaacggttgaggttcagggtcaggctgttgccctggttgaaaccgctcggtaccgcgcgctccaccgaggcaccgcccgggatgcggccggccgacggaacgttgaccgtgatcttcgaaccgtcacgcccctcggcgtcgaaaccgcccaccaccaggttgccctgggcgatggcgtagacgttgccgtcgatccccttgagtggcgtcagcagcaaggtgccgccgcgcaggctcttggagttgccgatggaggacacggtgatatccacctgctgccccggcttggcgaacgccggcagatcggcgctcaccgataccgccgcgacgttcttcaactgcacgttgccggaacccggcggcaccttgatgccgaactgcgacaacatgttgttgaaggtctgcagggtgaagggtgtctgggtcgtctggtcgccggtgccgttaagcccgaccaccaggccgtagccgatcaactggttggaacgcacgccggaaatactggcgatgtccttcagccgttcggcttgagcgtggcaggccgccgaaagcaacagcgcggccagcatgaggcgtttgaaattcaacgtagccacctagaaagggaacagcgggctgaggaagaaacggtcgaaccagcccggctggctcgcatcggcaaaggcaccggtgcccgaataggtgatgcgggcgtcggcgacgcgggtcgaggacaccgtgttgtcggtggcgatatcgtcggcgcgcaccaggccggcaatccgcaccagctcgtcgccggtgttgagggtcagccacttctcgccgcgcacggcgatgatgccgttgggcagcacgtcggccaccgtcacggtgatcgagccggtcaggctgttgctctggccggacttgctgtcgcccttggtggctcggtcgccgctgtaaccgacgtccaggctcaggtcgccgccgcccaccgggttattggtgctcaggccgccaccgaaaaacgaggtcaggccgatgccggtcttgctgttcttgtcgacctgcgagttggcgttcttgctcgcctgggtccgctcgttgagggtgatggtgatgatgtcgcccacgcggaacgccttgcgatcgctgtacaggttctgctcgaagccggcctggtagatcgagccattgttggccgcagccggcaacggagtacgtggcaacaccggagcgtaatacgggtcattgggcttcggcgttggggccacgcagcctccgagcacgacgaacccactcaatgcgagaacagatacaaagcgattcatgaccctacctcatggtgttgcaggcggccgctgggccgccccaggacttgattacagattctgcgtgacgaacgagagcatctggtcggcggtggagatcaccttggagttcatctcgtaggcgcgctgggtggtgatcatgttgaccatctcctcaacggtgctgacgttggaggtttccagggtgttctgcagggtggtgccgaaaccgttgaggcccggggtaccgacttgtggcgcgccactcgcggcggtttccaggaacaggttgttgcccgtcgcttgcaggcccgccgggttgatgaagtcggcggtctgcaggttgccgatcacttgcgaggccgggttgccggcggtggtgatcgagacggtgccgtcctggcccacggtgaaggtctgggcgtcgttcggcacgacgatcgccggctccagcgcgaagccgttggcggtgacgatctggccattggaatccaggtggaaggtgccgtcgcgggtataggacgtggtgccgtccggttgcaggacctggaagaaaccgcggccgttgatggccatgtccagcggctgctcggtggtctgcaggctgccggcggtgaagttcttctgggtgccgacgatgcgcacaccggtacccagttgcaggcccgacggcagctcgctgtcctgggtcgactgggcgccaggctgacgcttgatctgatacagcaggtcctggaactcggcgcgatcacgtttgaaacccgtggtcgaaacgttcgccaggttgttggaaatggtggtcaggttagtgtcctgggcggacagacctgttttggcaacccacagagccggaagcattcgattctcctcgtgcgcctgttttacggcgcgacgtactggtaattagctgatctgcaagacccgagccatggcctggtcgtcttctttggcggtgttcatcatcttgatgtgcagctcgaactgcttggagagcgccagcaccgaggtcatttcctcgaccgcattgacgttgctcgactcgaggaatcccgagaccagttgcacattggcgtcagccgctgccggcttgccgtccttggtatggatcgaaccgtccagccccttggtcatgttcttcaggtccgggttgaccagcttgatgcggtcgacctcggccatcacccgtggaccttcgcccatggcgcggatgctgatggtgccgtcctggccgacttccacctgctgctccggcggcacggcgatcgggccgccgttgccgatcaccggcatgccgttgccggcgcgcaacacgcccagggcgtcgatgttcaggctgccggtgcgcacgtagctttcaccgccctccggggtctgcacggcgatccagccattgccgctgaccgccacgtcgaggtcgcgaccggtttccaccagcgagcccggggtgaaatcggtagccggccgttcggacatggcaaaggcccgcgccggaaagctgtcaccaaacaccggcatcgaacgcgcctgctccaggtcgcgctggaaaccgttggtggagatgttcgccaggttgttggcatgcgccttttgcgccagcgcattctggctggcaccggtcatggccacataaaggtacttgtccacagtctttcctctgcatgtcggacgtttgccgtccaccgctgtactgctgagccataagcaataagcgcaccaacttgttttgcgggcggtcgaaggcaggaaatccgggagcttgagggcgttcgaagggaatcgggggattgtgtcagagacgaaaaaccggcgcagatatgccgcttacggcaaggctcggcctccaggcactcccctgcctcgccgctgctcctgtagccgctgccgcaggctgtgatcgaggccgcaggactcgcaggctggcaacgcatgacctcgacccgatcgcagactaaagatctggcgcctgctgcgcaaccgatcgcagcctgcggcagcggctacaggattcagctttcgtcggcgttcttgccgacttcgtattcgcgcagtttgttggcgatagtggtgtgcgacacgcccaggcgcttgcccagctgacggctgctggggtgttcggaatacaggcgttcgagcaccgccttttcgaagcgcccgacgatgtcgtcgagcccgccttccagggagaagtcaccaaggggttggcgcacgccatagtccggcaggcggatgtgctcggccttgaccgtgccgccgtcgcacagggacaccgcctggaacagcacgttttccaactgccgcacgttgcccggccagtggtaatgactgaggcgctccatggccgcaggcgccagcctgggcaaggcgcagccgatctgccggctggcctggtcgaggaagtgctccaccagcggtgtcaggccgtcgaggcattcgcgcagcggcgggatgtgcaacgacaggacgttgagccggtgatacaggtcctggcggaactcgccgcgggcgcacagctcggacaagtcgacctgggtcgcgcagatcacccgcacgtccaggtacacctcttcgtcgctgccgacccggcggaaacagccgtcctgcagaaaacgcaggagcttgacctgcaagcgcgggctcatctcgcccaccccgtcgagaaacagcgtgccgccggcggtcagttccagcagcccgagcttgccttcggcccgcgcgccttcgaaggcccccggcccgtagccgaacagctcggtctcggccatggattccggcaggccggcgcagttgagtgccatcagcggcgattgcccgcgcgggctggccaggtggcaggcgcgcgccagcagttccttgccggtgccggtttcgccctcgatcagcagcggcgcgtccagcggtgccatgcgccgcgcttcgcggaccaccgcggccatgactttcgagctctggaagatgctgtcgaagccgcgcagctcctgcttgcgcacgttgtagatgcgctcgccgacccggtccgcgcggtgcagcgtcagcaccgcgccggccatggcctcgctgtcgtcgtgctccgattgcagcggcgcgatgtccgccagaaacacgtcacccttgaccttgacccgcaggccgttgatccgcgacttgttggcccgcaccagttccggcaggtcgaaatcctcggcatagcgcgacagtggaatccccggcacctcgtccacccgcacgcccaacagctgcgccgccgcgcggttggcggcgacgatggaaccgcccatgtcgatggacaacaccgggaattccagcgccccaagcagcgcattgagctccatgtgccgccgctcgctgggcatcagcccgacccgcttgaccccgaacaccccggcgatcgattcgaacttcggccgcaatgcctggaactgcagattgatcaggttcgggcaatgcaggtagatggcattgccatgctcgccgcccacctcgccccgggccacgttgatgccgtactccaccagcaggttgagaatgtcgcgcaggatgccgatgcgattctggcagtggactttgatacgcatagaaggaaggcccgaggcaggtaatggagggcgtgaacgccagaaagcggcgtttttggcaccgtccgacaggaactttctgcgctgtgacgcagataatcgtcaagattatgtgacagtcgccggccttttcaaatcgactattctcagtattagcggcccctcgctgttttcgtaacgaaaactttacgaaatcagccctgatccgcccattacgttcacgtcaacctgctgcatgggctgcaaccttgggttatctctagcgtcaactgataacaagaagcagcccctgacaggagagcagcatgaagcagacgcagtacgtggcccgcgagcccgacgcgcaaggttttatccactaccccgatgaagaacacgcggtgtggaacaccctgatcacccgtcagctgaaagtgatcgagggtcgcgcgtgccaggaatacctggacggcatcgagaaactcggcctgccccacgaccgcatcccgcagctgggcgaaatcaacaaggtgctgagcgcaaccaccggctggcaggtagcccgggtgccggcgctgatccccttccagaccttcttcgaattgctcgccagcaaacagtttccggtcgcgacctttattcgtacccgcgaagaactggactacctgcaagagccggacatcttccacgagatctttggccactgcccgctactgaccaacccctggttcgccgaattcacccacacctacggcaagctcggcctgcaggccaccaaggaagaacgggtgtacctggcgcgcctgtactggatgaccatcgaattcggcctgctggacaccccgcaaggccagcgcatctacggcggcggcatcctctcctcgccgaaggaaaccgtctactgcctgtcggacgtgcccgagcaccaggccttcgacccgctggaagcgatgcgcaccccgtaccgcatcgatatcctgcaacctatctactttgtgctgcccaacctcaagcgcctgttcgacctggcccatgaagacatcatggccctggtgcaccagggcatgcagatgggcctgcacgcacccaagtttccgcccaaacccaaggcggcctgagcaccctgccctcgcgcggcgctcataaaacccgtaatttccaacaagaaccgacttcaggaacccaccatgaccgctctcaaccaagcccattgcgaagcctgccgcgccgatgctccacaagtcagcgacgaagaactgccggtactgatcaagcagatccccgactggaacatcgaagtacgcgatggcgtcatgcaactggaaaaagtcttcctgttcaaaaatttcaagttcgccctggcctttaccaatgcaataggtgaaatttccgaggcagaaggtcatcatcctggcctgctcaccgaatggggcaaggtcaccgtgacctggtggagccactccatcaagggcctgcaccgcaacgacttcatcatggccgcccgcaccgacgaagtggccaagaccgcagaaggacgcaagtaatgcatttcgacgccataggccgagtacccggcgacccgattcttggcctgatggaggcctatgcgtcggacagcaacccacgcaagttcgacctcggcgtcggtgtctacaaggattcccagggcctgacgccgatcccccggtcggtcaagctggccgagcagcgcctggtcgaccggcagaccaccaagatctacatcggcggccacggcgacgcggcctttggcaaggtgatcaatgaactggtgctgggcgccgattcgcagctgatcgccgaacgccgcgccggcgccacccagaccccgggcggcaccggcgcgctgcgcctgagcgccgacttcatcgcccactgcctgccgggccgtggcgtgtggttgagcaatccgacctggccgatccacgaaaccatctttgccgccgccggcatccaggtcagccactacccttacgtcggcagcgacaaccgcctcgacgtcgaggccatgctggcgaccctgaaccaggtgcccaagggcgacgtggtgctgttgcacgcttgctgccacaaccccaccggtttcgacctgagccacgatgactggcatcgggtgctggacgtggtgcgcagccgcaacctgctgccgctgatcgacttcgcctaccagggcttcggcgacggcctggagcaggatgcctgggcggtacggctgttcgcggccgaactgcccgagctgctgatcaccagttcctgctcgaagaacttcggcctgtaccgcgaccgcaccggcgcgctgatcgtctgcacccgggacgcggaaaagctgctggacgtacgcagccagctggcccacatcgcccgcaacctgtggtccaccccgccggatcacggcgccgcggtggtcgccaccatcctcggcgacccggagctgaaaagcctctgggccgacgaagtggaagccatgcgcctgcgcatcgcgcagttgcgttcaggcctggtggaggcgctgcaacccttcggcctggccgagcgcttcgcccatatcggtgtgcaacgcgggatgttctcctacaccggcctgacgccggaacaggtcggcaaactgcgcgatcagcacagtgtgtacatggtcagttccggccgggccaacgtcgctggcatcgacgccacccgcctggacctgctggccgaagccatcgccgcagtctgcaagtgacaccctgatcgcgagcaagctcgctcctacaggcagatgcttttgtaggagcgagcttgctcgcgatgctcttcaacgatcccccgcccgatgaaactcctttcatcctaaaagcccagataaaaatctttttgtcatttccagtgctgtatcctgcccaggctttttaaaagcgcggatctacccagcgatttaaaaaacagaccttgcgaggagcaacgaacatgcacgagattcctaatctccccttcccaagcctgcacgaaactgagcagacaaccccgcaacaagccggcgcccaacagcccgagccgaaagaagccgcacccggtcacaaggccgacagcgaagactgaccgcaacacccagaccgtgtggaaagcgctctttgatgcgctttccacaccgcctgaaacccgctttcgagaaccgcctccatgaccgacgccttcagcgaaacccaagccagcgtgctgatcggcaccgccgaaaagatgatcgagatctggaaccgcctgacgccggaaaaacaggccgccctgctagcgcgcttcggcacccaggaaaacgccctggccgccctggtcaccacgcaattgctggccccagcccaagcctgacctcgcgacgcgcaaaaacttgcgccagaacatcgatttctccaccagaatcgtttcaagcctcggtatcataagcagcctatctatctctgccgcgcccgtggacctttcccatgccagatacccagcgccccttggcggtcacgctgcaagtcgtctccatcgtccttttcacctttatcggctacctgaacatcggcatccccctggccgtgctgccaggctacgtgcacagcgagctgggcttcggcgcggtgatcgccgggctggtgatcagcgtgcaatacctggccaccctgctcagccgcccctatgccgggaagatcatcgacaacctgggcagcaagcgcgcggtgatgtacggcctggccggctgcggcctgagcggggtgttcatgctgctgtcggcatggctgcacagcctgccggtgctgagcctgaccagcctgctgatcgggcgcctggtgctgggcagcgccgagagcctggtgggctcgggctccatcggctggggcatcggccgcgtcggcgcgcagaacaccgccaaggtgatttcctggaacggcatcgccagctatggcgcgctggccgtcggcgcgccgctgggggtgctgctggtggatcgcctggggctgtggagcatgggcgtgagcatcatcctcctggcgctcctcggcctggcgctggcctggccgaaacgggcggcgccgatcgtcgccggcgagcgcctgccgttcatccatgtcctgggccgggtattcccccacggctgcggcctggccctgggctcgatcggctttggcaccatcgccacctttatcaccctgtattacgccacccagaactggtccaacgcggtgctgtgcctgagcctgttcggcgccagctttatcggcgcgcgcctgctgttcggcaacctgatcaaccgcctcggcggctttcgcgtggcaatcgcctgcctgtcggtggaaaccctcggcctgttgctgttgtggctggcgccggatgcccattgggccctggccggcgcggcgttgagcggcttcggcttctccctggtgttcccggcgctgggggtggaagcggtcaacctggttcccgcctccagccgtggcgcggcggtgggtgcctattcgctgttcatcgacctgtcgctgggaatcaccggaccgctggccggggcgatcgccgccggtttcggttttgcctcgatcttcctgttcgccgccctcgccgcctgcagcggtttgctgctgagcctctacctgtaccgccaggcaccgaagtatcgcgaggagcgcggcgagcgttagtagtcgaccttgccgcggctggccttgatgttgccgcgcttgctcttggactccaggcgccgggtcttcgagcccagggtcggcttggtcggccggcgcttcttctccaccttgatggcaccaaggatcagctccaccagacgctccagggcatcggcgcggttctgttcctgggtgcggtattgctgggccttgatgacgatcaccccgtcgctggtgatgcgactgtcgcgcagcgccagcagccgctccttgtagaacggcggcagcgacgaggccggaatgtcgaagcgcaggtgcaccgcgctggaaaccttgttgacgttctgcccacccgcgccttgcgcgcgaatggcagtcaactcgatctcggcatccggcagatgcacgttgttggaaatcaccagcatggaaaagacatccgctttcagggcgttcaggataccgcgcctgcggatttgcagcgcccacaaaaaacccggccgaagccgggttttccgttaccgcgcgagcctcacttcaacgaagcgttggccgcctgcaggctgtgctgcgcgctgcgcttgttcttgatgccgtagcagacccacatgaaggcgacccacaccggaatcgcgtacaccgagatctggatgcccggaatcatcagcatgatgccgaggatgaacaccacgaacgccaggcagacgtagttgccgtaggggtaccacagtgccttgaacagcggcgattgtttcgtgcggttcatgtgctggcggaacttgaagtgcgagtagctgatcatcgcccagttgatcaccagggtcgcgaccaccagcgacatcagcagctccagggcgtgctgcgggatcaggtagttgagcaccacggcaacgaaggtcaccaccgccgaggccaggatcgacatcaccggcacgccgcgcttgtcgatcttcgccaggactttcggcgcgtcgccctgctcggccatgcccagcagcatgcggctgttgcagtaggtgccgctgttgtacaccgacaaggccgcggtcaggaccacgaagttgaggatatgcgccgcggtatcgctgcccagcatcgagaacacctggacgaacgggctaccgctgtaggcatcgccggaggcattcagggtctccagcaggctgttccatggagtcagggacaacagcacgaccagggcaccgatatagaaaatcaggatgcggtagatcacctggttgatggccttgggaatcacggtcttcggcttgtcggcctcggccgcggtaaacccgagcatctccaggccgccgaaggagaacatgatgatcgccatggccatcaccaggccgctgacgccattggggaagaacccgccgtgttcccacaggttgctcaccgaagcctgcgggccgccgtgaccgctgaccagcaggtagctgcccagggcgatcatgccgacgatggccaccaccttgatgatcgcgaaccagaactcggcttcaccgaagactttgacgttggccaggttgatcaggttgatcagcacgaagaacgccgcggccgaagcccaggtcggcacgtccggccaccagtagtgcacgtacttgccgaccgcggtcagctccgacatgcccaccaggatgtacagaatccagcagttccagcccgacaggaaaccggcgaaaccgccccagtacttgtgcgcgaaatggctgaaggaaccggccaccggctcttcgacgatcatctcgccgagctggcgcatgatcatgaaggcgatgaagccgcagatggcgtagccgaggatcatcgacggaccggccgacttgagcacgccggcggagcccaggaacaatccggtaccgatcgcgccgcccagggcgatcagttgaatatggcgatttttcaggccgcgcttcagctcgcctgaatgcgagttttgtccactcatgaaaagggtctcacgcaaggtttgatgatgttcgatagacgttgcagccgacagcaggcttaagcagcgcggatcaaaccccagcgcaggcaccaggagttcagcgtttgtttaacggtcatgcgtcacctgtttgtttttatctgtgacgaaatcgaacccaccacgcttgtgacgcggcggagtgaacaaggcgggtagccttgagattattggccttgggagcgtgtctcgagcattcgagccagggctcgtcacgcgtcgaaaccagtcgttggggcgcaaaatgcgcggatacgcagttgagtcacagttaaaacgccgcgcattgtacacccctgactccctgccgccagacgcggcttatcagcgcgtcgggtgccggaatcgcacggggcctgctcgatgctgggcatcggcggcaaggttcgggacagacccgtcggggtcgtcgacgaaggtacgacagcaatcgcccttcggagggaataggttgaggtgagccacggcgttcattgcgcctccttcttgttatgcacctgcacacaggcatgggctgcatcacacctgccttgaggccgcggaacaagcggcttggcgcccggcggcgggctgtatcgaggcaacaacggaaggtttttcttacagcgccgaacaagggtcgattcgatgaatcgatagcgggttttgcgtaagcatttctttacaaagcggaacgtattttttccacctcagatcggtgacatcggcgactgcaaattgacggccagcgcttttttatctgtctgctcgctcagctttttgttttttcttgataatttcccagcgcaaaaacagaacaaaaagttcattaaaaataattcaattatttttttgcatttcaaaaaaccctggactaggtttccagccacttgccggaccacacccccggcaagccgagcggccacgttgagcagctggggctttcaagcactccccgtagaacgcccgagccgtctcatcgactgcttttatccgaaactgcttttatccgaaaaagtcatctaggagattcacgatgcaagcactggaaaaagacttggacactgaactgcaactggacgattggtttgaagcagcgacccacgaggccgcggtggaaatgatgcaggccgatgcggtagtaccgttcggcacggcgatgtggcctttgtaaaaacggccatcaggcaggagcggcccggcggtcgcccctgcctccatccgctgtctgtcagggaggatccatggacaacaccgctgccatccggcatttcctttactacctcgaacaccacccggccctggccgagcgccagagcgccagggtcctgatcggccacaccgccgaatacgccgccaccagcgccgccatcatcgagcaggccggtgaacccttcagtttcacagccctgcgtctcgacctcgaacccacctcggctctggcccaagccatcgccgactgcgacctgtatatcttcttctacgactcctccaccctctcgccgccccgcccgcaaggcccggagtttatccaggcgctgcagggcgtgatggccgagaactggaagaagtcgctgctgttcaaggactacggcgactacttctacgacaccttcagcgtcgagccgcagcgcatcgccgagctcaacgcgaccctgatccgccacatgtccgaggccaccaccctgagctttcgcgacgaccacggctcgtacttcgaagcgccgctggacagcatcaagaagtggaccaacatcaacggcgtgggcaactacgacctggcgcccggagaaatcgccagccacagcgaggccatcaatggccgggtgaaattcgtcggcaccttcctcggcaccatccccttcgcgcgcaagtacggcgtgctgcaatcgccgctggaactgtggatcgagaactccaccatcagccgcatcgccaccgacgtgccggggctggcggacgacttcaacaaatacctggatgccaacccgtccaaccggcgcatcgaagagctgggcatcggcaccaacgaaggggtgaaagacctctacgcgcgcaactcgggtttcgaggagcgccattgcggcctgcacctggggctgggcggcggggccaagggcagccatcacctggacctgatctttgccagcggggtgctggcgctggacgaccagccggtgttcgatggcaggtttgtgttctgagcctgcggctacataaaggcaaaaaaaaacgccaaccctgaggttggcgtttttttcttgttgcttacagcttgcggctcaaggctgcctcactcaggcttgcggcgaccgaaacccgggcgctggccggaaccggcggagcgccacgacgcttgcccgacggtgcgtccttgtcaaccaggacaatgcccggacgcttggacttcggcgctggcttggccgggcgcttggtgtcgctcggacgatccgccactggcgtaccgcggcccgactcaccccgaccggcagccggacgcggcgcccgtggagcgcgctcgccatcctggcgtggcgcgggcttgcggcccggacgctcgccttcgatctgcggctcgcgcgatgggcgcggggcaccggaggcaggcgcgccatgggccggacgcagggtccgcacgcgctcgctcttgcccaccgggcgcgaggatttgcgctgcatgcgttccagcttgtccttgctcttggcgttgagctgcggcatcgccaccggcgtcaagccaacctcggcgctgaggacgtccacttcgtactggctcatttcgcgccagcggcccatcggcaagtcggagttgaggaacaccggaccgaaacgcacgcgtttcaggcggctgaccaccaggccctgggattcccacaggcgacgtacttcgcggttgcggccttccatcaccacgcagtggtaccaatggttgaaaccttcaccaccgggcgcctgctggatgtcggtgaacttggccgggccgtcttcgagcatcacgccagctttcaggcgctcgatcatctcgtcgtcgacttcgccacgcacacgtaccgcgtactcacggtccatttcataggacgggtgcatcaggcggttggccagctcaccgtcggtggtgaacatcagcaggccggtggtgttgatgtcgaggcgaccgatattgatccagcggccttctcgcgggcgtggcagcttgtcgaacacggtcggacggccttccgggtcgtcacgggtgcagatttcgccatcgggcttgttgtacatgatcacgcggcggaccgattcggacgcctcttcgcgcttgatcaccttgccatcgatggagatggcgtcgtgcaggtcgacgcgcaggccaagggtggcctctttgccattgaccttgatccggccctggctgatccaggattccacgtcacggcgcgagccgacgccgatgcgggcgaggactttctgcagcttttcgcctgctgggccgatttcctgttggtcttgctgatcttcactcatctgggcacctcccggtgtgtcgattcaggcttgagcggcctgaacggtagtaaaaacaggtcttgtggcgaagggatcgccaaagggtcgcgaatcatacgctcatggcgccgattgcgcatcagagactagccgataagtggcggctcagcggtttttccgctggccggtggcagcgcaggcacctgggcgaccgaggcgtctcaatcgtcttcgagcaggcgtctttcgttctcgatggcttcggccagcgccagggcttcggcctcttcgtcgctcagttccggagccggcggttccagcgctgcgacggcggccagcagcttggcgcgggcttcggcgacgccgagcacatcgtcatcgacttcctgctcctgctcgtcgcgtgcatccgcttcgagttcggcctcgtgttcggcttcgtgctcgatttgcacttcggcttcggtacgagtttgcgtttcggggtcgatctcggagtccacctcggcgccggcaatcacatcgtccccggacgactcgaccgcgccatcgcgatgcagatcgtcgaagtcggtcttgatcccctcctccatcgagtccagctccagcagcaaggtgtggaaactggtctcttccttcggctcttccggttcggcgctggcgtcggccagggcttgcaggctggcgggcaccggcacgtcgtcgaagtcgaggaccggctcggtctcgatctcgcgcagctcggccaacggcggcaggtcgtcgaggttcttcaggttgaagtgatcgagaaacgccttggtggtggcgaacatcgccggcttgcccggcacgtcacggtagccgaccactcgaatccactcgcgctcgagcaaggtcttgacgatctggctattgaccgccacgccccgcacgtcctcgatctcgccgcgagtgatcggctggcggtaggcgatcagcgccagggtctccagcattgcccgggagtagcgctggggccgttcttcccacagccggccgacccagggcgcgaacttttcccgcacctgcaggcgataaccggaggccacttccttgagttcaaaggcccgaccttcgcaggatttgcccagaatggtcagggccttcttgaagaccgcggggtccggccgctcgccttcctcgaaaagttcgaacaggcgctccatggattgcggttttcccgaggccaacagaaaggcttcaagcaggggcgccagctcgcggggttcattcagattcattgtttcagctcgttattcggctcgcgcccgcacatggatagccgtgaagggctcattctgtaccagctcgaccagggattccttgaccagttcgaggatcgccatgaaggtcaccaccacccccaggcgcccctcttctgcggtgaacagctcgacaaagggcacaaaaccaccgcccttgagccgctccagcacctcgctcatgcgctcgcgggtggacagcgcctcgcggctgacctgatggctttcgaacatgtcgccacggcgcagcacctcggccatggacatcagcacctcttccagggcgacatccggcaacagcttgcgcgcccgggcctccggggcgtcgagcttgggcactatgacgtcgcgaccgacccggctcaggccgtcgatgccttcggcggcggccttgaagcgctcatactcctgcaggcggcggatcagttcggcgcgcgggtcttcctcttcctcttccacctcggccgagcgcggcaacagcatgcgcgacttgatctcggccagcatggccgccatcaccaggtattcggcggccagctccaggcgcaccgactgcatcaactcgacatagcccatgtactggcgggtgatttccgccaccgggatgtcgaggatgtcgatgttctgtttgcggatcaggtacagcagcaggtcgagcgggccttcgaaggcttcgagaaagacttccagggcgtccggcgggatgtacaggtcctgcggcatttccatgaccgcctggccgtagaccatcgcaaagggcagctcctgctgcgctccggcctggtcgtcgacgtgttccactgcggacattcaggcctcgaccatgaagggagccgggtcgccgcagccgatacggatcacttccggctcgccatcggccaggttgatcacggtggaggccatgatgccgccaaaaccgccatcgatgatcaggtcgacctgatgctcgagcagttggcgcatttcataagggtcgttcatcggctcggtttcgccgggcatgatcaggctgacgctcatcagcggctcgccgagttcggccagcagcgccagggcgatcggatggcttggcacccgcaggccgatggtgcgtttcttcgggtgcagcaacagccgcggcacttcgcgggtggcgttgaggatgaaggtgtaaggcccaggcagatgcgccttgagcaggcgaaaggtgccggtatcgatcttggcgaacaggcccagttgcgacaggtcgctgcagatcagcgcgaagttgtgtttgtcatccagttgccgcaggcgccgcacgcgctcgaccgcgctcttgtcgccgatctggcagccaatggcgtaggacgagtcggtcgggtaaatcaccacgccccctgagcggatgatttcgacggcctgtttgatcaggcgcggttgcgggttttccggatgaatctggaaaaattgactcacattctctacctgttcagacggcggcaataattgggtcatgtttgaaccgacaccaaagcggcggcagatcctccggaaccgggcgatactcgcctatctcggaccagcctccaggaccatgaaaatcactgccggcgctcaccagcagaccgaactcccgagcaaggatggccaggctgcccacctgctcggcgggttgatggccgttgaccacttcgatcgcgtggccacctgcttgaatatagtcggcaatcaggcgacgacgcttgctgcgggtgaaatcgtaatgccagggatgcgccaggctgacccaggcccccgccgcgcgcagcgtctcgacggtttcctcgagggtcggccagtgctgcttgacatcgcccaacttgccggcccccagccatttgcgaaaagcctcggcgcggtccttcacgaaaccggcgcgcaccaggtaatcggcgaagtgcggccgggccggcgcattgccgctgtcgcccagttcctgctggatcgcccgggccccttcgagggcgcccggcatgcctttgagcgccagcttgcggcttatttcttcggaccgcagccagcgaccgtcgtgcaatttgccgatggcttcgaccaatgatggcgcattgacgtcgaagccgtagcccagcacatgaatggtcgccccaccccaggtgcaggacaattcgacgccattgaccagttgcatgcccagttcatgggccgccaggcgcgcctcgtcgaggccttccagggtgtcatgatcggtcagggccaggactcgcacgcctttctcgaacgcacgcgcaaccagagccgcgggcgccagggcgccatcggaggccgtgctgtggcagtgcaaatcaacattcacgggactgttcaacctcaagtcagctggcgctttcgctaccatggatgtttgttattatgccgccacatcctgcttctggctgccactgtgaaacaattcatcgacttcatcccgctgttcctgtttttcatcgtctacaaaatcgatccccgagtcgtcgacattgccggtcaacaactgaccgtaggcggtatctacagcgccacggcggtgttgatcatcagctccctggtggtctacggcgcgctgttcatctcccagcgcaagctggagaaaagccagtggctgaccctggtcgcctgcctggtgttcggcagcctgaccctggccttccatagcgagaccttcctcaagtggaaggcgccggtggtcaactggctgttcgccctggcctttatcggcagccatttcatcggcgaccgcctgctgatcaagcgcatcatgggccacgcgctgaccctgccggatccggtctggacccgcctgaacatcgcctggatcgccttcttcctgttctgcggcgccgccaacctgtttgtcgccttcaccttccagagcatctgggtcgacttcaaggtcttcggcagcctgggcatgaccgtgctgttcctggtcggccagggcatctacctgtcgcgccatcttcacgacaccgaacccaccacgtcgaaaaccgaggactgacatgctttacgcaatcattgctacagacgtcgccaactccctggaaaaccgcctggccgcgcgcccggcgcatctggagcggttgcagcagctcaaggccgaaggtcgcgtggtactggccgggccacaccctgccgtcgacagcaatgatcctggcgccgcgggtttcaccggcagcctgatcgtcgccgaattcgactcgctgagcgccgcccaggcctgggcagatgccgacccttacatcgccgccggtgtctatgccagcgtcgtggtcaagccgttcaagcaagtcctgccgtaaatcctctcccgcgcggtgaaccttatgggttcatcgcgctctcaatcgctcattattctcgtttgactgccgacaacctgcccaacactcgattggaatcaggagttgcgatgcgccaaggtctgttgtgcctgttgttggtcatgttaacgatcggggcgagcgcctccgccgaagaaaccacggacccggggcattcgacgtctttgtccctgagtgccggcagccagatcagcgaattgcagcagcgcctcaaagacagcgagcgccagcgtgaagaactgacccggcaattgcagagcgccgacagcgagcgtgaaagcgcccagctgagccgcctgcgccaggagaaccaacgcctcaagctgcaactgcgcgaggcccaggccagttccgtgccacgcctgctgacagatcagcagcagtggttcgtcaccggcgccggggtagcgctattggccctgctctgcggtatcttcgccagtggtggacatagaaagcgtcgacaatggctaaattgagtgattcatgagcgacctgttactgattgacgatgaccaggaactctgcgagctcctgaccagctggctgggccaggaaggttttcaggtacgggcctgccacgatggcctgagcgcccgtcgcgccctggccgatcacgccccggcggcggtggtgctggacgtgatgctgcccgacggcagcggcctggaactgctcaagcaactgcgcagcgaccacccggacttgccggtgctgatgctatcggcccgcggcgagcccctggaccgcatcctcggcctggagctgggcgccgacgactacctggccaagccctgcgatccgcgtgaactgaccgcccgcctgcgcgctgtgctgcgccgtagccacccgaccgcggtgtccagccagatggagctgggcgacctgtgtttcagcccggtgcgcggcgtggtcagcatcgacgaacaggacatcaccctcaccgtttccgaaagccgcctgctggaagccttgctcaagcaaccgggcgagccgctggacaagcaggaactggcgcagatcgccctgggccgcaagctgaccctgtacgaccgcagcctggacatgcacgtcagcaacctgcgcaagaagatcggcccgcaccccgacggccgcccgcgtatcgttgccctgcgcagccgcggctactactacagcctctgatcctgaacagatccctggtcctgccgccgctgccgcaggctgcgatagggccgccgccctcctgcattcgcaagatccccgcgagcgtaccgctcgttcgcagcctcgcaggctcggcagcggctacaggcgttatgtcagtttcgccaaaaaacgtctttacccaagctttacccttcgctgaccgccgctgaccttgctctgcgtaatctgcacacatccggaactgaccgggaatgagacaaggagatacaccatgcgcaagaccctgatcgctctgatgttcgccgccgccctgccgaccgtggccatggccatgccggaaggcgcaggtcccatggggccgatggatggcccgcgccacagcgaacacatgcgcggcaaaggcccttacagccagctggacctgagccacgaacagcgccaacagatccgcaagctgatgggtgagcagatgcacgagcgcaagcagctggtgcagaagtacctggaaaaactgtcgccggccgaccagaaggccatgaaggacgagatcgccgccaagcgccagaaaaccgaagccgatatccgcgccctgctcaagccggaacagcagaaagagtttgacgccatccagaagaaacacgccgagcgccgcgccgaatgggccgaattcaaggcctggaaagcgcaacagccgcaaaaagcgcaataatgctcgaggctctgtacgtaaagtcgccgagcggcgatcaggcaaggcaaaaacaggcgaggaagcggagtttaggggcctaaatgagcattccgatcggactcgcgcacgagcctgtttttaacgcagcatgatcgatgcgcaggcagtttacgtacagaacctagcgcttatcccacagcccagcccagtggcccccactgggctttccttgtttgaggactttccgtgcgttcattgttctggcgcatcctcgccagcttctggctggccatcaccctggttgcagggctgtcgattctgcttggccacatgctgaaccaggacgcctggatcctcagtcgccatccgggcctcaataccctggccgaagagtggacgcgcacctacgaagaacaaggcgaagacgccgcccaggagatcctcgagcagcgcaagcaccagtatcacgtcaacgtgcaagtgctcaacgacgccggcgacccggtggtccgcggcaccttcccgcgccgcgcggccgccttggaggcccgccagaacaacgatgaccggcgcctgccctggcggcgcctgaccgccgaatacaccagcccgaaaaccggcgaaacctacctgctgatctaccgcatcccccacccggaactggacgcctggcatcgcgacagcctgctgtggccgctgagtgccctgaccatcgcgctggtggtgctgaccctgttcagcctgctggtgaccctgtccatcacccgccccctcagccgtttgcgcggtgcggtgcatgacctgggacaagccacctaccaacagaacagcctggcccgcctggccgcccgccgcgacgagttcggtgtgctggccaaggacttcaaccgcatgggctcgcgcctgcaaagcctgatcggcagccagcgccaactgctgcgcgatgtctcccacgagctgcgctcgccgctggcgcgcctgcgcatcgccctggcgctggccgagcgcgccacggccgaggagcgcgagcgcctgtggccgcgcctgacccgcgaatgtgaccgcctggaagcgctgatcagcgagattctggtgctggcccgggtcgatgccgacaacgccagcgccgaagaggtggacctcaacgccctgctcgataacctgcagaaggatgcccaactggcctgcccggaacagccggtgaacatccaggccgaatcgcaactcagcctcaagggctggccgaccatgatcgagcgggcggtggacaatctgctgcgcaatgcccagcgtttcaacccggccggacagccgatcgaagtgcaggcattgcgtcagagggacaggatcgtactcagcgtccgcgatcacggccccggcgtggaggccgaacatttgcgccagctgggggaacccttctaccgcgccccgggccaggccgcgccgggtcacgggctgggcctggccatcgcccggcgcgccgcggaacgccatggcggcagcctgaccctggacaatcatccgcagggtggctttatcgccagcctggagttgccgttggtgccaggcgttactgcccaggcctgagcagcctcaggatcaggccttgcccgaccaggcgctgacgaactccgccgtatccaccttgggcgcgacccgtggctcgttcagcggcgtgcccaggtacaggaaggcgatgatttcttcaccttcgcccaggccaaagccctgggcgacatggggtgaataggacagctcgccggtacgccacactgcaccgataccctgggcataggccgccagcaggatgccgtgggcggcacagccggccgccagccgttgctccgacttcggcaccttgacgtgctcctgcaggcgagccaccacaaccaccaccaacggcgcgcgcagcggcatggcacgggccttgtccagggccgcctgggtcacttcgcccccctgcaattgcaccgcttccaccagcaactcgcccaactgctcgcgggccgtaccttccaccgtcagaaagcgccacggccgcaactggccatgatccggggcgcgcaatgccgccgcgaacagcgcttcgcgttgcgccgccgtcggcgccgggtccaccagacgcggtacggaaacacggttgagcaatgcgtcgagagcctccatcggccacctcctgaaaaaaatgtccggccattctaccgggaagtgccttccgggtgccggtttacatgctctgcgccgcaggtagaatggcgccctccttatcagccccgagcggacctcatggcgttgccgaccctacggatcattggtttcatcatcggcattttcctgatcaccctggccatcgccatggtcattccgatggcgaccctggtgttgttcgaacgcaccggcgacctgccgtcgttcctctgggccagcatgatcactttcgtcgccggcctggccctggtgataccggggcgtccggaacatgtgcacctgcgtccgcgggacatgtacctgctgacggtgtccagctggctggtggtgtgcatcttcgccgccctgccgtttttgctgacccagcacatcagctacaccgactcgttctttgaaagcatgtccggcatcaccgccaccggcgccaccgtgctcagcggcctggacaacatgtcgccgggcatcctgatgtggcgctccctgctgcactggctcggcggcatcggcttcatcggcatggcggtggcgatcctgccgctgctgcgcatcggtggcatgcgcctgttccagaccgaatcctcggaccgctcggaaaaggtcatgccgcgttcgcacatggtggcgcggctgatcgtggcggcgtatgtcggcatcaccattctcggcagcctggccttctggtgggccgggatgagcctgttcgacgcgatcaaccacgcgatgtcggcgatttccaccggcggcttctccacctccgacagctcgctggcgcactggccgcaaccggcagtgcactgggtggcggtggtggtgatgatcctcggcagcctgccgttcaccctgtacgtcgccaccctgcgcggcaaccgccgggcgctgatcaaggaccagcaggtccagggcctgctcggcatgctgctggtgacctggctggtgctcggcacctggtactggtggaccacccagttgaattggctggaggccctgcgtcacgtcgcactgaacgtcacctcggtggtcaccaccaccggtttcgccttgggcgactacagcctgtggggcaacttctcgctgatgctgttcttttacctgggcttcgtcggcggctgttccggctcgaccgccggcgggatcaagattttccgcttccaggtcgcctatatcctgctcaaggccaacttgaaccagctgatccacccgcgcgcggtgatcaaacagaaatacaacggtcaccgcctcgacgaggaaatcgtccgttcgatcctgaccttctcgttcttcttcgccatcaccatctgcgtgatcgccctggcgctgtcgctgctgggggtggactggatgaccgccctgaccggcgcagccagtacggtgtcaggggtgggcccgggcctgggcgaaaccatcggcccggccggcaacttcgccaccctgccggacgccgccaagtggattctgtccctgggcatgctgctcggccggttggagatcatcaccgtattcgtgctgtgtattccggcattctggcgtcactgacagcggccccggactcctgcaatcgcgcccggtattcgccgggcgtggcatcgaaccagcggcggaaagcgcggaaaaagttgctcgggtcggcaaaccccaacagataggcaatctccagcaaggtcatgctcggctgcgccaggtactgctcggccagttcacgacgggtgtcgtcgagcagggtctggaaactggtgccctcctcctgcagacgccgttgcagggtgcgctgggacaggtgcagggtctgggccacggtttcgcgcttcggctcgccctggggcagcaaccggcacagtgcctggcgcgccttgtgcgtcacccggctttcggagaagcgcgccaggtactcaccggcgaagcggtcatgcagccgcgccatggcttcattggcggtcggcaacggcgcttccatatcggcccgctcgaaaatcaacgcatcgtaaggcgcgttgaacaccagcggcgcatgaaacgcctgcttgtagggctccagatcgaccggcaccgccccctgcatcaggacctggcgcggctgcagcgtacgcccggtcaaccagccacacagcgccagcgcacaggccagcgaggcctcggcactttgccgggtcggcggcagatgatcgccgtgcaccgtcagaatcaacgcataaccttcaggtaaaagtcggaaactcagatcagcgctttccgcgatgatccgctgatagcgcaccaaacgctggaaaccctcggccagggtacgactggacatcagggcatacccggccacattgaaggaggccggtcgcaccaccttgcccatgttcaggccgatcgccgggttgccggactgctccaccgcacgctgccagagacgcgtcatcgagtcctgggggaagcgtgcgtccgggtcgtccagcgcggcatagtcgagcccgatctgcttgaacaatgcacggcaatccaggccgtccatctccagagctttgacaattcccatcgcccagcttgcagaagtcgttcgttcgctcatggtgggttcttttacatgatgagccgcaggctacggtcgatttcccaaggataccaacctgtagagcgtaatttacatccctttatttacaagggttccagacagttcatcttagccggttagggatcgatagaagctatgggactccgccatgccaatataatggcattccgcctttccatctcgtgctatccaataggctgaatagaatcctgtcgccaatggcaatccgcatgagcatcatgtaatgtgcatgccaatttatataccgttccgtgcaaaggaccgcagcaaatgcttctgtttttttccgctcttctactgtgcattcctttgcgaatctttgttccagctttgggtgtcgagattgccccggctgatgtattgtgcctatttgcgctgctctatgtattaacagtccaccctaaaataaatcgctggcttcttcttagtactttcctgtcactcatctcactaatcttcgtccaatcgacatacatgcctggcaatatcggtcgcgcattactttccatggctttttttttcaaaccatatttaatctacctgctaggacaaagccttggaatacgaagctttcagccagaaaagttcaacaagacaatcatcttgcttctttctatcacagcctttgcagccactgtcgatgccatattcgtcaaacatcatgtagctgcaattgcagaattcgaaaggatacctggagagtggattctgggcggtatattcgaccctactttctttggcttgaagttccacggcagtaatggcatcaatggaattgccgtattcttttcttttgcatttatgacgttgctagcgctcggcgtcgttatgaaacccgtaaaaagtgtaaaaatcattgcatgtatcggcatgctatgttgcttgattctggttcttggcagtggttcaagacaagccgcctttggcgtgctgatcagcggtatttgttatttgctcatgggaaaaatgacaactaacagactattttgggcgaacctttccggggttttcgcgatactggtgacactagtcgtaataacgttcttctcacaatatttcgtcgaactgtttgcgaaggctcgaataatggccgagaacatctccgatggaaactgggacgccgtatcctctggaagactgggtctatatgtaatccttgtcgaggatttgttaaaaagcccaatattcggcaccgggttcagcggctatggaattttcgactctggactgggttactttgaaaatgatgtcagtacttccgggtacacccctcataatcagtacctgggtgcactgtggaaaatgggggctctcgcggggattttctacttcgccttcctttggagcattacccgcccattctttaaaaacccacaaaaaaccaaataccaacgcaatctatatatagcgacagctattcttatcgttccatttttcactgtattcaatgtattccaggatggcttgtcctcaccatccactggaccattattgcttttcctcattggttactacaggcgggggctcgaattgagctatctggataccaatgagactccagatagcaaaccggcccagcaggttgatgccaagctaccgacataaagtggcttggcagcacacttgtgcgctaaagctggccaaggtcactacgaaccgcttgccccggctgtcccggttgctccgcggcacgccgttttctacggcaagatcattggtatagccaccctctacctgtaccggcggcatctgtaacatcgacacagataactatcagattggtagtgtcgtccgcgtcattcgtgctgactcacgaactgcaaaactgctgaaagcaccgatggtcgtcagcgcgcagttactgggctggcgcgtagctcactgaaccaacgcaggcctccagcatccagccgcccgagcggccctccacctcctcgctgaagaactcagaaggaaactaggaccccgtacgttactcgaaccgggcttaccgtgcctccacctcaaggctgcggcgtctgttggcaaaccatccgatgcaagtcgcgtatcagatagttcataagcactgaactgcaatcacaagaatgtattactgctggacaccttcgtctgacacaaaggcagatagatgcggaaaacatttctcaaaggcaaaggggctatggccatcatattgcctctaaaccttatttcctgagtctgacatccaaggatactaaagtggcgcctattgtcactggccccagccattgatgactctagactcaaataagctccccgcagagcatcccgctgacagaacaacaaccacagagatcgcagtcgtggataacatcaagcaattcaatagcttcgccgagttctatccgtattacctgagcgagcacagcaacagcacctgccgccgcctgcacttcgtgggcacgaccctggtaattttcatcctcgccttcgccatcggcaaaggcgcctggctattgctgctggccctgccggtggccggctacagctttgcctgggtcggtcatttcttcttcgagaagaaccgcccggccaccttccagcatccgctctacagccttctgggcgatttcgtcatgtaccgcgacatgctgaccggcaaggtgccgttctaggcctggccggacagcaaggcgtcctgcacagccagtgcaggattggatccaaggcatagactcccatcgttgcgcacaaaaacaacaagaggatggccgatgaacgctcacgcccgtttcacccacatgaaggatggtacccaggaagactgggcgatcatcgccgcggacttcagcgcctacgccaagcagttgccagcgcgcatcgtggcgcacctgaagttgctcgagggcgattttggcggcttcccggtggaccgcctgacccactcgctgcaaaccgccagccgggcctggcatgacggccgcgacgaggaatacgtggtctgcgccctgctccacgacatcggcgacaccctgggttcctacaatcacccggacatcgccgcggcgatcctcaagcccttcgtcagccccgagaacctgtggatggtggagaagcacgggatcttccagggctactacttcttccatcacctgggcatggaccggcacctgcgcgagcaattcaaggaccacccgctgtatctgcagaccgccgaattctgtgccaagtacgacgccgcggcattcgatccaggctacgacagcctgcccctgagctttttcgaacccatgctcgaacgcctgttcgcccagccgaaaaactcgatctacaaggccgccatgaaggaacacgcgccggcctgagaacagctgagcggccatcgcgagcaagctcgctcctacaggggggatctctggtttttgtaggagcgagcttgctcgcgatacttttcaggccagctccgcgaccttggccagttcggccttgcgctgcgcctcgcgcgcctgggcgtcggccaggcgatacagctcgatggtgccgtcccaatgctcgatcagggcggtgcacgactcgacccaatccccgcagttgagatagtccacctcgccgaccttgcggatctcggcatggtgaatgtgcccgcacaccacgccgtgcagctcgcgcttcacgcattcgtgagcgatggcttcctcgaagtcgctgataaagctgaccgcggtcttgaccttgtgcttcaggtaggccgacaacgaccagtaaccgtagccgtagcgcgcccgccagtgattcagccagcgattgagggtcagggtgaactcgtaggccgaatcgccgagaaaggccagccagcgatggtagcgggtgatgacatcgaactggtcgccatggatcaccagcaggtgccggccgtcggcggtgacgtgcaccgcctcgtccaccaactggatattgcccaggatcagcttcgaataacggcgcaggaattcgtcgtggttgccggtgacgtagatcacctcggtgccgcgcttgctcatggtcagcaggcggcggatgacgttggtgtgtgcctggggccagtacatgccgccgcgcagcttccagccgtcgatgatgtcgccgaccaggtagatccggtcggcgtgatagcccttgaggaactgggacagatgctccgcctgacagtcccgggtgcccagatgcacatcggaaatccacagggtgcgcacgcgttgtttacggctgggtctggcgagttcggcactggtcatgggcacgctcctgcattttctgcgagcttgcaccccagcgattaatcgcctgtgacagaaatacggcagtccgatgacaacgctgaagcccaggccgccggtgtagactgccgttctgccaaggagactgcgatgagaccgatcctcacgctacgccaatacagccacgacctgattgtccacagccacgaacacgcgcaactggtgttcggcctgtcgggccagctcgacttcgaggtcgacggccagggcagccaggtggtccagcagagcttcgtggtagtgccttccggcgcccatcatgcctgcggcagccccaacggcagtcgctgcctggtgctcgatgtgcccgacgaacattggctgctgcagtcgctgggcgatcacgccgatgccagtcgccgcctgctcgacaaccctgggcgcctgcccctggatacggcgcagagccaactggtcaactggctcgccggcagcccggtcaacgacccgctgattgcccagcaaggcgccgtgctgttgctggccagcctcaaccaggccagccccgccagcgtcggcggccgacgcctgccctatgccgccttgaatgcccatatcgataaacacgccgcccatccgctgcaagtggccgacctggcgcaaatcgccggactgtccagcgctcgcctgcatgcgcggtttgtcgccgaatgcgggcagacgccgatggactacatccgcagccggcgcctgcacatggccgccgggctgttgcgcgattcggcactgcccatcggcgaaatcgccagccgcgtcggctacagctcccagagcgccttcgccgccgcggtgctgcgcgagttcggcgtctcccccggcaagctgcgacgcgcgacgggccagcgctagactgtcgacaaaaaacgcgaggatcgcgacagaccgggtcctgcccaggcttttagactggcaccgctgcgctcaaccgttttgaaggattgaaatgactccgcgtactgcccttggcgccctgcatatcggcgcattgatgttcggcctcaccggtgtattcggcaaactcgccgccgcttcgccggccatcatcgtctttggtcgcgcggcgttcgcggtgctcgccctggcgttcttcgcccgctgcgccagcagcatccgctggcaacggctgcaggccacggacgggtggcgcctgctgctcagcggcctgctgctggccgggcactgggtgagtttcttcatcgcggtgaaagtcgccggcgtggccatcgccaccctgggcttcgccagcttcccggccttcacggtgatcctcgaagggctgatttttcgtgagcggatccgcctcaacgaaattgtcctggtggccctggtcagcgtcggcctggtgctggtcacgccggacttcgacctcgccagcgaagccaccagcgggctgctctgggccgcgggatcgggcctgctgttcgccctgctgtcactgaacaatcgcgccagttccgcacgcatcccggcggtgcaggcggcgctgtgccagaacgtggtggttgccttgtgcttgctgccggtggcggcgccggggttgagcgaggtacgggccatcgactggttgtggatcagcctgctcggcatcttctgcaccggcctggcccacagcctgttcgtcgccagcctcgcggtgatcaaggcgcgcaccgcggcggtggtgttcgccctggagccggtctacgggattaccgtggcctggctgctgttcaacgagacgccgacgctacggatgctgatcggtggcgtcttgatcatcctcgccatcgtggtctccagcagcctgtccggctcaagcaaaaaagcgccagtggcagaagtcgcgtctcactgagtgcggtcgttgtggccgaggtcgcgctgcggatcgatctggtcgcgcacccgctgcttgagtaccttggcttcgggaaaaccgccatcggccttgcgttcccagatctgtacgccgtcgcaggcaatgcggaacgtgccgccggtgaccggttccagggacaccttgcccaggtcgtcgctgaaggtgctcagcagttcctgggccagccaggcggcgcgcagcagccactggcactgggtgcaataggtgatgaccacttcgggtttacgttctgacatggtgctgccgactcctgggctcaagggcgtcgttataatagccgcctttatcgctcgccccgagatccatgatgcgtcgtttgctgtcctgcctgctcctgtgtttgctccccgtgttcctgcacgccgccgaagcgccacggccgaagatcggcctggtgttgtccggcggcgccgcccgtggcctggcgcatatcggcgtgctcaaggccctggaggagcaaggcgtgaagatcgatgcgattgccggcaccagcatgggcgcggtgatcggcgggctgtacgcctcgggctacaagatcgacgagctggaaaaactggccctgggcatcgactggcaacaggcgctgtccgacgcgccgccccgggaagacataccgtttcgtcgcaagcaggatgaccgcgacttcctggtgaaacagaaactcagcttccgcgacgacggcagcctcggcctgccgctgggggtcatccagggccagaacctggcgctgctgctggaaagcatgctggcccatgccagcgatacccgggacttcgacaagctgccgatccccttccgtgcagtcgccaccgacatcgccagcggcgagaaagtagtgttccgcaagggccacctgccccgggtgattcgcgccagcatgtcgatcccggcggtgttcgccccggtggaaatggatggccggctgctggtggacggtggcatgaccgacaacattccgctggatgtggcccgcgacatgggcgtggacatcgccatcgtggtcgacatcggcaccccgctgcgctcgcgccagcagttggcgaccgtggtcgatgtgctgaaccagtcgatcaccctgatgacccggcgcaactccgaggaacaactggcgaccctgcacaagaatgacgtactgatccagccgtccctggccagtttcggagtcaccgacttcggccgcgcccaggaaatgatcgacgccggctaccgcgccacccgcatcctcgacgcgcgcctggcgccgctgcgccgggccgaaccgatggatgccgaactcagcgccgcgcgcacgcccagccagcgcaccccgatcatcaccgcgatccgggtggaaaacgattcgaaggtcagcgacgacgtgatccgttactacatccgccagcacatcggagagcctctggacctgggccggctgcagaccgacatgggcacgctgtacggcctggattacttcgagcaggtgcaataccgcgtggtccacaagggcaatgaccataccctggtgatcaacgcccggggcaaacgcagcggcaccgactacctgcgcctggggctgaacctgtccgacgacatgcgcggcgacagtgctttcaacctgggcgccagctaccgagtcaacggcatcaacagcctcggcgccgaatggctgacccgggtgcagatcggtgatcagcaggagctctacagcgagttctatcaaccattggatgtcggctcgcgctacttcatcgcgccgtatatcggtcttgaatcacagaacatcgaagccgtgctggataacgacccgatcgccgagtaccgcctggaacgctatggtttcggcctcaatatcgggcgccagatcggcaacagcggcgagatccgtttcggtgtcggcgaggcctggggcaaggccgatgtccgtgtcggcgaccaggacctgcccagcgaaagcttcaacgagggttactacgaactgcgctactcgttcgactccctggacaatgtctacttcccccacgcgggcgaggatatcggcctgtcgctgcgccagttcgaacccagcctgggctcggacaagcgctaccggcagtgggagttcaagctggacaaggccctgagcagcggcccgaacacctttatcctcggcggtcggtatggccggaccctggatgaggccgaagtggtgacctcaagctttgtgctgggcggcgcccgccagctgtcgggcttccgccaggatgcgctctcgggccagaacgtcagcctgatgcggggcgtctactaccggcggctgacaccccgctcctacctgcccctggacttcccgctgtatatcggcggctccctggagcgagggcgggcctggaacaacgacaacgagttcgacagtggctacatcaacgccgccagcatcttccttggtttcgacacgccgctggggccgctgaatttcagttacggcatcaacgacgacaaccagaaagcggtctacctcaacttgggccagacgttctgaggcttggcgtccgactcggcttcggccttgctgccggagcccggttcgtctggctcctccaggcgccagacgatcgaatcggcattgaatggcgccggtgctgcggtaggaggcggcggagcgctggagggctcggaaggtgcgatcaggtcccagtcgacatcgatcgacggctcgcgatcagccaaccgatctcctgccacgggctgtaccggagcaacagggggcgttgatctgaacgactcctgggctgccaccgtcgtcacagcactggccagcgttcgtgtgggccgactctcgggggccgtctgtgcttccggtacggcggcggactgacgacggcgacgtatgaccaacaccaccagccaggccgtcagcagcaaggcggcaagcatcagccagggattcgagccctcatcagtctctggggcctgttcggctggctgaggtgggctgacggcggtgggtgtcgcgggcgcgggcgccggggcaggattatcggcaggcttgctcagggcttcggccaactgacgttgcagctccaccagctgttgctgctggcgcgccagttgttcgtcccgctgctgcaatgtgttgcgcagctcttgggcctggtcctgcaattgctgcttggcctgcagggcttgcgccaattgtccggccgcaggatcgctcgccttggccgccgcgtgtggcgcctgggtggcgatcgccggttcgggttttgctatgtccctgagcggagccggcactatctcggggcttcccgggggatcgatcagcagcgtgtactcgcgcaactgccggccattggcctggttcacctgcagcaggaaatccaggaacggctcgttcaccggcttgctcgacactacccggatcaccctgcgctcgccctgcaaaacctgggtaaaacgcaagtcttcgagaaacggcaagcgctcgataccggcctgcttgaactcgctggccgtcgccaggctgactgacaactcgccctcttccagagcttgtgcctgcaccagggcgatctccgcctccagcggttggttcagcgccgaatgcacggtgatttcacccaggcccaccgccgaggccagggacgaatacaaggtcgccagcaccggcagaaggaacaaggaacgattcttcgccacccaggacgacccgacgaaaccgcgcagagcggccagcagactctggaacatgagcaccctttttgaggaccgaaagcgaccacagcggcgatacgctggctgcgcatgccgctgtggacctggtatttcttatagtccgccggtgtcggtagctcaaaaatccgcggcgctagttatgcctcaagacttttccagattggccaggatgtgcgcatgaacccgcatgcatacccgcatatcctcttcatcgacaccgacgaacaattcactgcgcagggctgtggcgatggtttcgatctgttcgatcaagggcagcgccggggcgcacagaacgatcttcttcgcccggcgatcctcgaccaccgactgccgttgcaccaaaccctgggtttccaggctgtcgagcagccgcgccagggtcggtccttcgacgccgacactctgggcaagttcacgctgggtcggggcttcatcgaaacgggcgaggtgcagcagcaccagccagcgggcctgggacaggccaagtccggccagacggcgatccagttcggcgcgccagcctcgggacatctgcgccaactgcatgccaaaacggtgttgatcggttaacggcataaacaactcatgagttagtagactgaaaattaagaaaaactaattattagtcagctaagcatgacagttgccgagtggcaaggtttgccatgaactgaatcgttacatcttgccgccgtgggactcacatctcgaattccgattccagcgctgcacgcacgcaatacagcacaccttccggcacgcgaccggcaaacagctcggccacttcgctcaccgagggcagctcgccttcgccgtcgagaaaggcgtcctggatctcgccgagcaggtcttccggcagatccagcgcctgttccagggacaactgctgcttgcccacggcttcggcgagcatcgtgtaaacgttcttttccgagcactgcaattgcccggcgatctgcagtggcgtcatgccggcgcgggccagggtaatcagctcatggcggatgtcggccaccactttcggcgcctccacctggccgcccaacacttcgaggaacgcctcgccgtagcgctccagcttgcgcgcgccgacgccgctgacccgggccatttccgccagggagccgggctggctgcggagcatttccagcagggtggaatcggggaaaatgacatagggcggcacgccatgttcttccgccagcttgcgccgcagggcgcgcaaggcttcccactgttcgcgctcttcgccacgtaccagttggctggcctggctggtgctgctcttggcggcggtctgcggctttatgtcgcggcgcagctccaggctcacctcgcccttgagcagcggtcggcagctgtcgctcagacgcaagccgccataaccttccagatcgatgtcggccaggccgcgggccaccagttggcggaacaacgagcgccattcgccttcgctgcgcgccttgcccacgccgaacacggaaagatgctgatggccgaagctgcggactttttccgtgtccttgcccagcagcacgtccaccaggtggccgacgccataccgctggccggtgcgatagatcgccgacagcgcctggcgcgccggctcggtggcatcccaggtctgcacgccgtcgacgcagttgtcgcaatggccgcatggctgtggcatgtcttcgtcgaaataggccagcagagtctggcgccggcagcgggtttcctcgcacagcgccagcatggcgtcgagcttgtgctgctccaggcgcttgtggcgttcgtcgccctcggaattctgcagcatctgcttgagcatcagcacgtcctgcaggccgtaggccatccaggcatcggcaggcaggccgtcacgcccggcacgcccggtttcctggtaataggcctcgagggacttgggcaggtccaggtgcgccacgaagcgcacgttgggtttgtcgatgcccatgccgaaagcgatggtcgcgaccatgatcagcccttcctcgttgaggaaacgcttctggtgataggcccgcagctcgctgggcaacccggcgtgatacggcagcgccggaaagccctgctcgcagaggaatgcggccacctcgtcgaccttcttgcgcgacaggcagtagacgatgccggcgtcgctgcgccgttcgctgaggaacgccagcagctgcttgcgcggctgttccttgggaacgatgcgatagaagatgttcggacggtcgaaactggagaggaaacgctcggcatcctgcaagtgcaggcgattgacgatttcctcgcgggtgcgcttgtcggcggtggcggtcagggcgatgcgcggcacccgggggaacatttccgccagctggcccagttgcaggtactccgggcggaagtcatgcccccactgggacacacaatgcgcctcgtcgatggcgaacagggcgatgtcgaggttctgcaggaacgccagcatccgcggttgcaccaggcgctccggcgccaggtacagcatcttcacttcgccccgccggatgcacgcggccaggtcacgctgctgctcggcgctcagggtggagttcagcgccgccgcggcgaccccgagttcctccagggtcgcgacttgatcgtccatcagcgcgatcaatggcgaaaccaccaccgccaggccttcgcgcagcagggccgggacctggaagcacaacgacttgccgccgccggtaggcatcagtaccagggcgtcgccgccactggccacacgctcaatgatcgcaccttggcggccacggaaactgtcgtagccgaagatgtccttgaggacgcgttgagcctgttcgagcatgaaaaactccaaaaatcgctgaaatccctgtgcgcaggctggccgaaaagaccacggttttcactgacaaatccgttagcggacttttcctggaccgtcatgacgcctgccgggcatcacaaaacgcgcaagtatacccgagcacttgccggcgaaggggccgactatggaccgtctataacctttagaagcgcgcaaatctgcgcggcggctggcctgggcgctcaagaaagcctagaattcagcatcgtttattcccaaggtagtccttcaatgtccttcgctgagcaattaacccgcctgcaagccttcctcgacgccgatgagctgcatgacgaggcgctggactatgtggccgcccacggctacctgactgcgctgtccatctgttccgaaagcgttcccgaccgagagtggatcgacgccctgttcgccgaggagccgcactacagcgacgccgcccagcgcgaagagatcgagtccaccctgattgccctcaaggcccacatcgcccgccaactggcttccgacgaagagttcgagctgccgtgcgacctcgacctcggcgacgagccggacgactccgacctgcgcggctggtgcatcggtttcatggaaggcgtgttcctgcgcgaagcggcctggttcgaaaccgccgaggaagaagtcagcgagatgctcctgccgatcatggtcggctccggcctgttcgacgaacaacccgagttctccgacatcgccagcgatgccaacctgatggacgacatgatcgtgcagatcccggaagccctgaccgcgctgtacctgctgtgcaacgcgccggacgaaaaaccggccattctcaagccccgtcaccactgagtcaccgcctatggccaagcccataggcaaccgccccctgatcctgcgttacgttctgctggccatcggctggctgagcgtagtgctgggggtgaccggcatcttcctcccggtattgcccactacccccttcctgctgctggccgccgcctgctttgtccgcagttcgccgcgcttctatcggtggctggtggaacatccgcggctcggcccgtggatccgcgattacctggacggccacggcatcccgctcaaaggcaaggtctacgccatcggtctgatgtggctgagcatcggtctgtcctgctatctggtgcccctgccctgggcccgtggcttcatgctgaccagcgcggtgctggtgacgatctacatcctgcgccagaagaccctgcacaagccttgaacccggccctgcgcgccgccttcctccattcgtggcaacccgaccagctgcccatgctcgcgaaaaataccgcctagacttcagacacctgcattcgagcagcccgccatgcccgcacgttcgcgtcgccccgagtggacactgctccggtttcggctggccggctggtcgctgttgctggtctgtttgtggaccgacccgggcaatgtgcgggcgaactgggaattcgtttctgccctgagcaccttcgagtaccgtcatcaggtcctgggcccggcccgggagcgtctcgaggcctggaaccagttgttgcaggacctgaccgggcgaccggaatacgaacaactcaatgccatcaaccgcttcttcaaccagcaactgagcttcaaggaggaccagcgcacctggcagcagggcgattattgggccacgccgatcgaggccctgctcaagggcgccggggattgcgaggactatgcactggccaagtatttcagcctgcgcagcctgggggtctccagcgacaaactgcgcctcacttacgtcaaggccaggcgcggcaaccggccgcacatggtcctggcctattaccccagccccggcgccggaccgctgatactggacaacctcagcagcgacattcgttccgccgcccagcgccaggatccgaacccggtatacgccttcaatgccgaggggctgtacctgcccggagtggctggcgacacgcgcagcatcgacccgaaaaaactctcgcgctggcaggacgtactgaaaaagatgcgggacgagggcttcacggtgggtaatggctgatccgacaaggagtgccgaatgtcgctactcaagcaactgttcatcgccatctgcctgttcctgctggtggccttcagcggcagtttttttgtcagcctggaaagctcccgcgagcagatgctcaaccagctgcgctcccacgcccaggatgcggccaccgccctgggcctgtccctgaccagccaggtcgacgacccggcgatgatggaactgatggtcagttcgatcttcgacagcggctactacaacagcatccgggtggtgaacatcgaagacgaaagcattctgctggagcgttcggtgcctgccaggatcgagggcataccccagtggttcgtcaggctggtgagcctgcgcccgcaaggtggcgacgccctggtcatgcgtggctgggaacaggtggcgcgggtggaagtgctgagtaacccgcagttcgccctggccaggctctgggacagcagcgtcggcagcctgctctggctgctggtgtgcggcttgctcagcgcggtgttcggcggctggctactgcggcgccagttgcgaccgctggacgccatggtcaggcaggccgaagccatcagccaccgcgagttcctcagcctgccgacggtgccgcgcacgcccgagctcaagcgggtggtcctggccatgaaccagatggtggaaaaactcaaagccctgttcgccgaagaggccgcgcgcagcgagaaactgcgggccgagtcctatcaggacagcctgaccggcctggccaaccggcgcctgctggacgaacagctcggcgatcagttgctgctcaacgagcagagtggcgatggttatctgctgatgctgcgggtcaacgacctcagtggcctgaaccagcgcctgggtggccagcgcaccgacgccctgatcaagagcatcggcgatctgctcaagcgcatcagcgcccaggccgaccgacgccactggctggcggcacgcaatcgcggcggcgaattcagcctgctgacaccgggcctggacagccgcggcgccgagcgcctggccatggaaatcagcgccaccctggagaacctgcgcctgaccggggccagcgactgcacaccggtggcgcacctgggcatagtcgcctaccggcccggcgacccgctgagcggcgtctggttgcgcctggaccaggcgctggcgcaggcccagcagcaccccgagcgtccctgggcattgctgcaggagttcgccgccggccccagccagccgcagcatgactggcgcgcctggatcgacgacgccctgagcaacggcaagttgaagttgtatttccagccggtggtgcagtgcgccgacaccagcgaggtgctgcatcacaaggtgctggcgcgcttgctcgacccgcagggcgaagccattgccgccgggcatttcctgccgtggatcgagcgcctgggctggtcggcacgcttcgacctggccatgctcgaacacaccctggattatctgctcgagcatgcctggccgctggccctgagcctgtccggcagcaccctgcgcgaccccgacgcgttgcggcggatcctcgaccagctcaaggccctgcccgacctggccaagttactgaccctggaaatcgacgaacgccaactgccctcggccagcgagctgcagcaattgagccagcgcctgcgggacagcggctaccggatcggcctgcaacatttcggcggcaacttcagccagatcggcaacctcgcccacctcggcctggcctacctgaaagtcgatggcagctacatccgcgacatcgaccggcaaagcgacaaacagctgttcatcgaggcgatatttcgcgccacccacagcatcgacctgccgctgatcgccgaacgggtcgagacccagggcgaactggacaccctcaaggccctgggcctgttcggggtcatggggcgactgatcggcccaccggaaccgatgtagccccttccccgcacagccccggcgccaacctcggtcaaggctggcgccgggcccgccgggcctcagacggtatcgaccttcaacgaatggtcattgagcatgccgttgatgatggtcgcggtatccgcgccacccgcgatcactccgcctgcgcccggtgtcaccccgtagtgctccgccaggttgaccccggccagatcgatggtctggctcggcgaggcccccgccgccgcgctgacgtcgatactggtgatcagcgacggaccgctgccagtgaccgtgaagtgcaggtaatcatccagcgatgcgctgctggcgttctcgccctgcagcagttgcgacaggtcgagtttgtcgatgcccggcgtgaagtcggtgaccaggtcatgcccgctgttgccctgctgccactggaaggtgtcgctgccgctgccaccggtcagggtgttgttgcccatcccgccgatcaacaggtcgtcgccgccaccgccgttgagcacatcgttacccaggccgccggtgatgatgttggcgttgttgtcgccggtcagggtgtcgttgtagttggagcccaccaggttttcgatggcggtcagggtatcggtcccggcgccaccggtgttctgcgcaccgagcagcgagaggtcgaccgtgacctcggcactggcatgggcgtagctggcggtgtcgttgcccgtgccgccgtcgagcaggtcgttgcccggcccgccgaacagcaggtcgttacccgcgtcgccatgcagggtgttgttgccgctgccggcgatgagcacgtcgttgccgtcgccggcattgatcaggttgtcgccgctgccggccagcagcacatcgtcgccagcggtgccggtcagggtatggccgtcctgataactgatgctcaccgccgcgctgtcgctgccgccatggctgtcgctggcggtgtaggtgccgtggtaatccggcgtggactcctggccgcccgcgtagttgacggtcatggtcagctggtagttttccgaaccgttggcgttgctgccgctggggttgggcaagttgatgagatggatctggtagatcccgtccgcccccgcggtgaacgagccgccatcggcgatcgcggtgtaggccccgccattgaaggcgtactccatgcccacccggcccgccaccacgttgtgatccagggtcagggtctcgccctgtttcaggctgacgctgatcacatcctcgtcattgtcattgccgttgttgatgctgcccagcaagccgctgaccaccaccacggcggtcatggccagggaattggcattgaaggaggcccgggcgacgctcagggtctggctggtacccccggtgaaggcaatggtctgcaggctggcggcggcaaagtcggagccaggcgactgccagccagtgttgaagctggtcggcgcggccgtcagcggatcgccgttggcgtcgctgtcgttggctagcagggcatcggccggcaccacgatagtgcccgacagaatgttggtgatgatgtggtcgtcgcccgccaccggcgccgcgttcggattgaccttgaccaccagggtcgcgctggccaggtcgccgtcgttatcgctgacggtgaagccgactgtctcggtcagcaccacgctggtgactttctgcgaggtgtaggtgtaatcgccggtgtcgagtttcaccaccagcgtgccgccgttgttggtggcgatgctgaggctgttgtccagggtattgaaggtgccgtggttgaccccgccgctgaagctcagcgagccctggttgctattgccgttggggtcataggtataggtggtgccatcgaccaccagggtcttgatgaaaccgccgtcggcgccgaacgagccaccttcgccgagcaggctgccggtgaccggggtgccctgtaccgtaccggccagcaccgagtcgagctggttcaggtcggtgaccaccaccgcattggtatcgatgtgggtactgccgtcataggccagcgggtcaagattgctgttgctgacgccgctgcccaggccgattgcatagttcttgatgccgttggcgtcgaggaaggctttccaggcggtttcgtcggcggtgccgatttcctggccatcgttgggcttgccgtcggagaagaaataaccgacgttctgcgccccgctgatctggccactggtgacaaacgccagcttcgccgcggccacggccgcatcgtagttggtgccgccgcccgcggtcagggaggcgatgatcgacttggccgtcgccacatcgacccagatcggcgtcttgtccgtggcgctgctgctgaaggtgacgatctgcaccttcacatcgcccatgtcgtcgtacttgtcgagcaaagtgctgatcgcctgcttggccagctccaggcgcgacaggccggggacgcccgacggatcggccatgctgccggagacatcgatcaccagcagcaggttggaatcgacctccagcgcggtgaccgcccgctcgctggcgaccgcctggggcacatcgtcgacgatgctgatctggatggtgctggtggtggtattgcccaccacgtcggtggccttgtaggtgaagctttcgctcagcacgttggggccgtcgttggcggtcggcgcggtttttggcgccgaggtcagggtgtagcggtaggtaccgtcggggttgagcaggatctgcccgtaagtgccggtggcgctgccgaccagcgtgtaggtaatcgcaccgctgccgccgatgaccgagccgaccagggtgccgctggcggtttcgccggtgttgcccgggtcactgccgatcaccgtgccggctgccaggtcctggccgtccttgttcaggtccagggctttttcgaagacagtgacatcctggtcattgacggccctgagctcggtgtcgcagatctggatggtgatggtggtggtgctttcatcgccgtccgcgtcacgcacggtgtagacgaacacatcctgcgaatcgtgagcggtgaccgagttcggatagctgtgataggtcgcgttgccgaaggcgtccagggtcagcgtgccatacaggccgttgatggtggtgttcaagccgccaatggccgaggtcgaggtgtcgctaccggcgcgcacgccgaccaccgcgccagtgattgccgggccatcggcgccgccaatgtcgttacccagcacgttgccgctgatggtcgtgccttcatcggccatcgccacatcgggatgagcggtgggcaggtcatcgacgatattcacatcgagtaccccggaggcactgctgccatcgccatcgctggcgaacacagtgaaatgctcggcgatgctgttggcccccagcccagtcggatggctctcattgtcgagcagggtgtagctgtaggcgacgacaccgatactggcgtcgtagccggtaatggtcagcacgttacccaaggccgtcaggatcgattgcgggaagctcgcggccaccccgccggtcaccacattgatcccgcccaccgtcagggtttgcaggccgtccggggcgttgaccaggaagaagccgctctgggtcaaggccggggcgttggggctggtgccatcgctgaggtgcttctcgtagaccgtcagctcgccgccctcgatatccaggcagtgcagggtcacgcagtcgtcgttgttatggacgttcagcaccaggttggcggtgctcgggtcgccatcggcgtcggtgagggtgtaggcaaaggtttcggtaccgctgccattgccctgcaaggccttgaagtcggcgtccgcggtgttgagggtgtaggtgtaagtgccatcggctgcgaggaccagggtgccgtaggtaccggtgaaggtgccggcggtcactgggcctgtgggtacgcggtcagcgccctgcacgtcgttggtcaacacattgccgctgagcaccagctggctttccgaggccacgccattgctgtcatcgactgccgttggcaggtcgtccaccacgttcacatccagcgaaccgctggcggtgctgccatcggcatcggtggcgaccacattgaagtgttcgctgaggctgttggcgccattggcggttgggtgatcctcgttgtcggccagggtgtagctgtagctgatcaccccggtggcggcgttgtagcccgtgatggtcaaggtgttgcccaggtcggtggtgatcgattgtgggaaaccggcggcgactccaccgctgaccacagtgatgccacccaccgtcaaggtttgcaggccgtccagggccgtgacggtgaacgtgccgctctgagtcagggccggggcattcgggctgctgccatctgacagatgcttttcgtagaccgtcagttcgccgccgttggtatccaggccatcgagggtcacgccgtcatcgttgttatggatgttcagcaccaggttggcggtgctcgggtcgccgtcggcgtcggtgagggtgtaggcgaaggtttcggtaccgctgccattgccctgcaaggccttgaagtcggcgtccgcggtgttgagggtgtaggtgtaagtgccatcggctgcgaggaccagggtgccgtaggtaccggtaaaggtgccgggtgtgactggaccggttggcacacgatccgcaccttggatgtcgttggtcaatacattgccgctgagcaccagctggctttccgaggccacgccattgctgtcatcgactgccgttggcaggtcgtccaccacattcacatccagtgaaccgctggccgtgctgccatcagcatcggtggcgaccacattgaagtgttcgctgaggctgttggcgccattggcggttgggtgatcctcgttgtccgccagggtgtagctgtagctgatcaccccggtggtcgcgttgtagcccgtgatggtcagggtgttgcccaaggccgtggtcaccgattgcgggaagcctgcggccaccccgcccgttaccacgttgatcccgcccaccgtcagggtttgcaggccatccagcgccgtcacggtgaagatgccgttctgggtcaacgcgcccgcatccgggctgctgccgtccgtcaggttcttctcgtagaccgtgatttcgccgccttcggcattgaggccctgaatcaccaccgtgtcgtcgttgttgtgcacctgcaacaccaggttggcggtgctgctgtcgccgtcggcatcggtcagggtgtaggtaaaggtctcggtgccgcttccgccgccctggagggcgaggaacgccgaatcaccagggtgcagggtgtaggtataggtaccgtcggccgccagcaccagagtgccgtaggtgccgttgaaggtaccggcgatgatcggtccgctgggcacccggtcggcgccttgcacatcgttggtcaggacattgccgctcagggtcagttggctttccgaggcgacaccattgctgtcgttgaacgcctggggcacatcgtcggtgatgttgatatccagcgagttgctcgccgaatcgccattactgtcgctggcgaccacggtgaaatgttcgctcaggttgttggcaccgtcggcggcggaatggatgtcgttgccgaccagggtgtagctgtagctgaccgtacccgtggcaggatcgaaaccggtgatggtcagggtgttgccgagggcggtggtaatagactgcggaaagccggcggccaccccgccactgaccacggcgatcccgcccacgctgaggctgagcagcccgtcgggggcggagacactgaaggtaccgttctgcaccagcgccgccggattgctcgccgagccttggggcagattggcttcgctgagggtcaactcgccattggcgaccgacaggccgcccagggtgaccgggttgttcggtgggggtggcggcgcgataccgccgtcgtcgctaggcggtaccgcggcaatccgctcaggcacgaactcagggattccgttgaagcccgcggtggggaaaccaatgatcggctcgacccgacccgcgacttcttcaagcagtacaaaggtatgcccgccacccagggcgccggcggtgccacccgtagcaccggggccggccgcggtggcttcgccggtctgcgtcgggtcggcgccggcagcgatggctttctgcagttgttcgacatcggtcagttgcgcctggctgggggtcacggcttcaggagcctgcacatggggcgcctggttcgccagcagttgcggggtcaattgcaggctgctgtcgcgcccgagggtcagttcctggccgttctgcagatgcacggctaccgcgccctgcgcaccggtcaccagttgatcccctgcaaacagacgatcgccttctaccagaacgcgccggctgccatccgccgcgaccgctaccacctgcccgattaccttaccgacgacaccgattaacctagccatgagcacttcctccgctgccgaccgctatcggcatctggttgcacggaaaagtgctatggcgttatcgggtcaccgacgggaaacgccagcctgaaggttcgctgacttttgctcagtcgaacctgcgcaccggccttccctctcgctcgtccctcgctggcctgctgtttctgccgaaggtaaaaccgaatgcaatcaaacgcatccaggcttcggacagccctcccgcgaaagtcgcgacacggattcaaacactgcgagtgacaaaaaaatgtcgcattgaaatccgtatcgcaccctccccaccgctcctcttccgccctatgtcgcaaattttgttgaaccttttgaagtccctgaaaagctccctagagcctataaatacggggcttgcgaactgaacaatgtgctggatttcacagagtgcataagtttttttcagcataaggcttatgagaaattcttcttagcttgcgctcaggatgttcttagctctgttgttacaagcctgaaacggtttgaccttcaaatttcgtcatttttttggcgaccgcaaagcaccatacatggaccagggagatgtacctcatgcgcgtttttacccccctcagtagcgcgattttattagccatggcctgcattcatcaggcccaagccatgtctctgacggaggcgattcaaagcacgctggacaaccacccggaactgcgcgcgagccagaacaaccgtctgtcggcggatgaggacgtcaaggtcgccaaagggggcttctatccatcgctggacctgaatgctgcctatggccgtggctacagcgacaacaccactacgcgcgcgttgggcaaccatcacaccgagaccctgacctatacccagtcggagttgcgcctgcggcaaatgctcttcgacggcttcaataccgccaacgaagtcgggcgtacccagtcggtctccaactcgcgggcctactacacccgcggtaccgccgagagcctggccctgcgcaccatcgaggtgtacctggaagtgctcaagcgccgcgaactggtgaccctggccaagaacaacctgcaggcgcacctgcgggtcaacgaccagatcggcctgcgcagcgaacgcggcgtcggcagcaccgccgacctcgaccagtccaaggcccgtcgcgccctggcggaaaacaactacgacacggcgcaggtcgacctggccgacgccgaggccaacttcttcagcgccgtgggccgtatgcccgacgaactggaaagcctgccttcggtgcgtggcgagatccccgccagcctgccggatgcccggcagagcatgctggagaacaacccctacctgaaatcggcccaggccgacgtgcaagcggccgagagccagtacgaggtcgccaagtcgccgttctacccacgcttcgatgccgaggccgcggtgggcgccaacgacaacgtgcagggcgacaagggccacgacaatgaatggcgagtgggcgtggtgatgaactacaacctgttccgcggcggcagcgacaaggcccgcctgcaatcggacgcgcacaagatcaaccaggccatggacatccgcaacaacgcgctgcgcatgctcaacgagaacatcaccctggcctggaacgccatgctcaacgccaagaagcagacccccaccgctcgcgaatacgctgaaaccaccacccgcgtacgggccgcttaccaggaccagttcggtctcggccagcgcaccctgctcgacctgctggacagcgaaaacgagctgtacaacgccaaccgccgctacaccgaggtgcgctacaccgaggagttctcgatgtatcgcgtgctggcgaacatgggcgagttgttgaacaaggaaaaagtcgtggtgccagccgaagcgatcgcccagaccgaagtgaagagcgaagcccgtctgcctgagatgcgttaagtccgcggaggacttcaatgtgaccagcatggaacccgggagctcaggcgtcgatccgcgcctgagctttgatgacccgttgttggacggattgttgatcctctgcaaactgcacgactgcaccgtcagtcgggccagcctcagcgcggggctgcccctggcccagcaacgcctgagcctggacctgctgccccgcgccgcggcccgcgccagcctgcaggcccgcctgctgcgtcgtgagctgtcggcgatttccaggctcaacctgccggtgctgctgatcctcaagcatggccgctgcgcggtcctgcgccgctggggcgatgacggccaggcgctgatcctgcccagcgaagccgaaggcggcgagcagtgggtcagccaggcggagctgaacgatgactacagtggccaggcgctgttcgcccggccacgccacgaactggaagaactgcgcaattccctggtgccgcgggtcgaagcctggttccgcgacaccctgaaactctcgcgctggctgtacagcgacgcgatcctcgccagcctgctgatcaacctgctggggttgatggtgccgctgttcgtcatgcagacctacgaccgcgtggtgcccaaccaggccacctcgaccctctgggtgctggccatcggcctgttgatcggcaccggcttcgagctggtgctgcgggtggtgcgcgcccatctgctggacagcgccggcaagcgcaccgacgtgatcctctccgccaccctgttcgagcgcatcaccggcatggcgatgaaagccaagccggcgaccatcggcggcttcgcccagagcatccatgacttccagggcctgcgcgagtttctcaccgccgtgaccctgaccagcctgatcgatctgcccttcgccgtgctgatgctgctggtgatcggcctgctcggcggctggctggtggtgatcccgctgctggcgtttcccctgaccatcgtcttcgccatgctgatccaggcccgcctgcgcgacaccgtgcaaaagagcctgagcctgggcgccgaacgccaggcgctgctgatcgagaccctcggcggcctggaaaccctcaaggcctgcagcgccgaaagcgaacgccagcacaaatgggaaagcacccacggcgccctcacccgcctcgacagccacgcgcgcaatctctcggccctggccaccaacggcaccctgttcatccagcagttctgcggcatggcgaccatagtcgccggggtctacagcatcatcgccggcaacctcagcgtcggcgcgctggtcgccacctacatgctcggcagccgggtcctggcgccgctggggcagatcgccgggctgatcacccgctaccagcaggcgcaactgaccatgcgcagcaccgacgccctgatggccctgccccaggaacgcgatgcccgccagcgcccgctggaacgcacgcaactgcaaggcgcgctggcgctcaatcaggtgaccttccgttatcaggggcagaatgccgcggccctgagcaatatcagcttcagcatgcagcccggcgaacgcatcggcatcattggccgcagcggctccggcaagagcaccctggggcgcctggtcatgggtttctatgcccccgaggaaggccagttgctgctggacggcctggacctgcgccaactggacgtggccgacctgcgccagcagatcggctatgtcgcccacgacctgccgctgctggccggcagcctgcgcgacaacctgaccctcggcgcccgctacatcagcgatgcgcgcatgctcgaggtcgccgagctgaccggagtcaccgagctggcccgccagcatccccagggcttcgaccggccggtgggcgagcgtggccagttgctgtccggcggccagcgccaggccgtgctgctggcccgggcgctactgctggacccgccgatcatgctcctggacgaacccaccagcgccatggacaacagcagcgaagatgccctgcgccagcgcctgcacgcctgggtgcaaggcaagaccctgctgctggtgacccaccgcacctcgatgctcagcctggtggaccggctggtggtcctggacaacgggcggatcgtcgccgacgggccgaaagaagcggtcatcgatgcactgcgcaagggccgtgtcggctctgcggcagtctaggagtcgccccatgcctgcctcatcgcaatcacgcggctacttcgccagcctgcgcaaaagcgcggaaagcgagttcatgcccgaaaccgccggcgcctcgctgcaggattcgccccgcggctcgcgcatcgtcgtctggctgaccaccgggctgctcatcagcgccctgctctgggccaagttcgcggtgcttcaggaagtcaccaccggcgaaggcaaggccatcccgtcgagcaaggtgcaggtggtgcagaacctggaaggcggcatcgtcaccgagatcttcgtgcgcgaagggcagatggtgaacaagggcgacaccctgctgcgcctggacgacacgcgcttcctgtcgaacaagggcgaaagcgaggccgaccgctatgccttgatggcccaggtcgaacgcctgtccgccgaagccgagggccggccgttcaagccgtccgacgaagtggtggccaaggccccccaggtggcggaggacgaacgctcgctgtacgaacagcgccagcgccgactagccagcgaacagcggaccctgagcgaacagctgcggcaaaagacccaggaactggcggaattccgttcgaaacaggggcaattcagctccagcctggccctgctcaaccaggagatgaacatgtcggcgccgctggtgagtaccggcgcggtgtcaccggtggagatcctgcgtctcaaacgcagcgcggtggaaatccgcggctcgctgaatgccacgaccctggccattccccgggcggaatcggcgatcaacgaaatcaggagcaagatcgacgagtccgaacagggcttccgttccgatgccgccaaggaactcaacgagaaacgcaccgacctgtcgaaaatcaccgcctcgagcatcgccatcgacgaccgggtgacccgcaccaccgtgacttcgccggtgcacggggtgatcaagcagctcaaggtcaacaccatcggcggcgtggtccagccgggcagcgacatgctggaaatcgtgccgctggaggacaacctgctgatcgaggccaaggtgcggccacaggacgtggccttcctccatcccgggcagaaagccatggtcaagttcagcgcctacgactacaccatctacggcggcctgagcgccaggctggaactgatcggcgccgacaccatcgccgacgacaagggcaacagcttctacctgatccaggtgcgcaccgacaggaaccacctgggcggcgacctcaagccgctgctgatcatccccggcatggtcgccacggtggacatcatcaccggcgagaaaagcgtgctcgactacctgctcaagccggtgctcaaggcgcggaccgaggcgatgcgcgaacgctgatacacgtccccctgtagccgctgccgcaggctgcgatggggcgcgcagcgccccctgggcctgacaccgcgtacctcctgaaagaccgaggcgcctggatcggcgcccgcttcgcggtcgatcgcagcctgcggcagcggctacaggtctttcgcctgccattgcctacgttgcaagactcctcccccatcgccgcaatctgcccatcgatcaaggatgcgcaaacgctgccacctccctgtagccgctgccgcaggctgcgccggggcgcgcagcgacccggcctgacaccgcgtacttcctgaaagaccacgctgcctggatcggcgcccgcttcgcggtcgatcgcagcctgcggcagcggctacaggtctttcgcctgccattgcctacgttgcaagactcctcccccatcgccgcaatctgcccatcgatcaaggatgcgcaaacgctgccacctccctgtagccgctgccgcaggctgcgatcggggcgcgcagcggcccctgggcctgtcaccgcgtaccccctgaaaaaccaagccgcctggatcggcgcccgcttcgcggtcgatcgcagcctgcggcagcggctacaggtcttttgtctgttggtggttgcgttggtaggtgtcttcgcccattgccgcgatctgtccgtcgatcaaggcttcgaaaggtttcagcaaaggttcgaacgaggttggcgcctccagggtctgcagggcctggacgatggcctcgatggtcgacagggcccccggcccgggcgccttgcgcagccggtaacgggacaccgcgcctgcggccagggtcactcgcggcaacgcggccagcagcggattgaggtgcagcaacttgcgcgccttgcgccaggtaccgtcgggcaccaccagcagcaaaggctgctcgtccggcacgctggaataggcctgcaacggctgcgcgtcctccgccgggaacagcaggcgcgcctgatacccgggacagttcaacagcttcggcagatcggcaaacacctcgccaacgatcaactcggcattgttcaaccccagcgccgccagccgcgcggtgttcagcgcgtggttcacttcgctgggatgctgcaacagcaggatccgggtgcggctgtccagccgtggaatcagcgggcacaggcaatgggttttcgggcgcaggcaacgcgggcattgaattctcgacatggggcgcctcctcaggcctgattgagctgcgccttgagcaggtcgcggaacgtctggatcaacggttcgcggctgcgcccacggcgcacgatcatcgaaaacggcgcctgataaccgaaggtcgccggcagcagcacgcgcaaatcgcccttgtcggcccaggcctgggcgtaatgctccggcaggtagccgatataggcaccggacagcaccaggatcagctgcgcctccatgctctccaccgtcgccgcgctgtgcttgaagccgtggcgcgccagctcggcctggctccagtagccacggccgaccatgcgctgctgggtgatcacctgctcggggatgcgccgctcgttgaacagcgggtgccggctgctgcaatacagccagtgctgctcgcggtacagcggcatgtacaccagcccgctcatgcgcgtggagaacgcaccgatggccaggtccaggcggttgtcctgcacgccgagctgcaattcgtagggactgagtaccgacagatgcaaatgcaccgccgggtgttcctggctgtaggcgccgatggcttcggcgaacggcagggccttgtcgctcaccgtcgagtcgatcacccccaggttgagggtgccgcgcagttcgcccttgagcgccgcggcgtactgctcgaaaccctccagctcgcccagcaggcgcagggtttcctgatggaacagctcgcccttgctggtcaggctgaaaccgccgcggccacggtggcacaggaccagccccagggccgactcgagctggctcatgtaggtgctgatggccgacgtagagaggttcagttcgtgctgggcattggcgaacccctgatgccgcaccacgctgacgaagatgcgcaatagtttcagatcaggtaaagcgttggccatgggagctccacaaggaaaatcgacaacggggatcgggtgtcagggtcatccagacctcattggcgttccttcatgaacagcgtcgcggcgccgattatgaccgctgtgcggccaatcgcgggcaagcctcgctcctgcagaagcacgagcgaggcgtgggcgccacctgctcggcgtgaacaacgccgcgctcgcagaggccaaagtctatcctttacgcccagcattaatttagaaaaatctgaactaagtatttgcccgtagcgattcttcccgcctactacatttcgcagaatcggccccactcggtttcgccggcagtcattgccgcgccacaaaccccataaataaaacaacgatgaggccaatcccgtggacaagattctccaccaaccactgggcggcaacgaaatgccgcgcttcggcggcatcgccaccatgatgcgtcttccccatgtgccgaccccggccggcctggatgccgccttcgtcggcgtaccgctggacatcggcacctcgctgcgcgccggcacccgcttcgggccccgtgagatccgcgccgaatcggtgatgatccgtccgtacaacatggccaccggcgccgcgcccttcgactcgctgaacgtggccgacatcggcgacgtggccatcaacaccttcaacctgctggacgccgtgcgcatcatcgaagaagcctacgacggcatcctcgagcacaacgtgatcccgctgaccctgggcggcgaccacaccatcaccctgccgatcctgcgcgccatccacaagaaacacggcaaggtcggcctggtgcatatcgacgcccacgccgatgtcaacgaccacatgttcggcgagaaaatcgcccacggcaccaccttccgccgcgccgtcgaagaaggcctgctggactgcgaccgcgtggtgcagatcggcctgcgcgcccagggctacaccgccgaagacttcaactggagccgcaagcagggtttccgcgtggtgcaggccgaagagtgctggcacaagtcgctggacccgctgatggccgaagtacgggcgaaggtcggtgacggcccggtgtacctgagcttcgacatcgacggcatcgacccggcctgggcgccaggcaccggcaccccggaaatcggcggcctgaccaccatccaggcgatcgagatcgtccgtggctgccagggcctcgacctggtcggctgcgatctggtagaagtctcgccaccgtacgacaccaccggcaacacctcgctgctgggcgccaacctgttgtacgaaatgctctgcgtgctgccgggcgtggcgcgtcgctgaggcccggccatgagcgagcgcgagcaggtcctcaaagccgccgccgaactggtagcggccttcgcccgtaacgatcgcgaagcctacttcggtgcattcagcaccgacgccagcttcgtcttccacaccctcgcccagcccctgctgtcccgcgacgcctatcaggcgctgtgggacagctggcgccgcgaggatggcttcgaggtgctgtcctgcacttcgagcaacgcgtttgtcagcctgcagggggacaccgcggtatttattcatgacgtcgccaccgagctgcgcatgcaaggggagcaacacttcagccaggagcgcgagaccattgttttttgcaaacaagggtccggcacacaacaacaaggcctatggctggcctgccacgaacatttgtccgcaatgccggaagggctgccacccccttaggttctgtacggaaagtcgccgagcggcgatcaggcaaggcaaaaacaggcgaggaagcggagtgtaggggcctacatgagcattccgagcctgtttttaacgcagcatgatcgacgcgcaggcagtttacgtacagaagctagccagacaggtgacgctcacacacgacgagcgcgcctttgtgatcggagcagatcatgaataacaacaaagaaaaaagccttagcagcatcgaaacaaacggggtcgaacagatccccgaccatgaacgcgacgcccggcccagcgacctgtttcgcctgatcttcggcggcgccaatacctttgccaccgccgtgctcggcagtttcccggtgctgttcggcctgtccttccaggcgggtgtctgggcgatcgtgctgggcgtgatcctgggggcattgatcctcgcgccgatgggcctgttcggaccgatcaacggcaccaacaacgcggtttcttccggtgcgcacttcggcgtgcacgggcggatcgtcggttcgttcctgtcgttgctgaccgccatcgccttcttctccctctccgtatggagttcgggggacgccctggtgggcggcgccaagcgcctggtcgacctgccggaaaccgacctgaccctgggcctggcctacggcctgttcgcgatcctggtactgacggtgtgcatctacggcttccgcttcatgctatgggtcaaccgcattgccgtctgggcggcgagcctgctgttcctgctggggatcttcgccttcgcgccggccttcgacagccagttcgccggtaccgtggccctcggccaggcgggtttctgggcggccttcatcggtgccgcgctggtggccatgagcaacccgatttccttcggcgcgttcctcggcgactggtcgcgctacatcccccgcgaaacgcctaaaggccggatcatgctggcggtgatcgccgcacagatcgccaccctgattcccttcctgttcggcctggccaccgccaccatcgtggcgatcaaggcgcccgactacatcgccgccaacaactacgtcggcggcctgctggcggtctcgccgagctggttcttcctgccggtgtgcctgatcgcggtgatcggcggcatgtccaccggcaccacctcgctgtatggcaccggcctggacatgtccagcgtgttcccgcgggtgctgtcgcgggtcaaggcgaccctgctgatcggcgtgctgtcgatcgccttcatcttcatcgggcgcttcgccgccaacctggtgcagagcgtgtcgaccttcgccgtgctgatcatcacctgcaccaccccgtggatggtgatcatgctgatcggcctgctggtgcgtcgcggcttctactgcccggacgacctgcaagtcttcacccgtggcgagcaaggtggccgctactggttccagcacggctggaactggcgtggcctcggggcctggatccccagcgcgctggtcggcctgtgcttcgtcaacctacccgggcagttcgtcggtccgctgggcaacctggccgacggcatcgatatcagcctgccggtgaccctgggcctggcctcgctggtgtacctggccctgctcaacctgttcccggagccggccgcggtctacggccccaacgatccacgcagcaagagcacggattcgctcggtaaaccggtcatgcgcgaaaccgcctgactcatgcatgacctgtagcggcaggctcgcccgcaatcacgccccacacgacggatccagccccccgtcgccttgatcgcagcaagcctcgcatctacagcaagccactataagaaagacaatcggagacacgccatcatggctttagatctattcgtcgtactcatctacgccgccggcatgctggtgctcggctactacggcatgcgcaaggccaagacccacgaggactacctggtagccggccgcaacctgggcccgaccctgtacatgggcaccatggccgccaccgtgctgggcggtgcctccaccgtcggcaccgtgcgcctgggctatgtccacggcatctccggcttctggctgtgcgcggcgctgggcctgggcatcatcgccctcaacctgctgctggccaaaccgctgctcaagctgcggatcttcaccgttacccaggtcctggaaaaacgctacaacccgatggcccgccaggccagcgcggtgatcatgctggcctacgcgctgatgatcggcgtgacctcgatcctcgccatcggcaccgtgctgcaagtgctgttcggcctgccgttctggatttcggtgctgctgggtggcggcgtggtagtgatctattcggcgatcggcggcatgtggtcgttgaccctgaccgacatcgtccagttcgtgatcaagaccgtcggcctgatgttcatcctgctgccgatctgcctgtaccgcgtcggcggctgggatgaactggtggccaggctgccggcgtccagcttcagcttcaccgccatcggctgggacaccatagtcacctacttcatgatctacttcttcggcatcctgatcggccaggacatctggcaacgggtgttcaccgccaagaccgaaaaagtcgcgcaatacgcaggcaccgtcgccggcttctactgcattctctacggcctggcctgcgctctgatcggcatggccgcgcatgtcttgctgccggacctggacaacgtcaacaacgccttcgccgcaatcgtcaaagcctccctgccggacggcatccgtggcctggtgatcgccgcggccctggccgccatgatgtccaccgccagcgccggcctgctggccgcctccactaccctgaccgaagacctgttgcccaagctgcgtggcggcaagcagtcgagcctggggatcaaccgtctgttcaccctgctgaccggcatcgtggtcctgggcatcgccctggtggtcaacgacgtaatcagcgccctgaccctggcctataacctgctggtgggcggcatgctgatcccgctgatcggggcgatcttctggaaacgcgcgaccaccgccggcgccatcgccagcatgggcctgggtttcctcaccgcgctggcgttcatgttcaaggacggcctggatgccaacaccccgatctactacagcctggctgtcggcctgatcagcttcgtggtggtgagcctgttgtctcgtcgcccggcaaccctggccaacgcgatctaacctcaggtcagacgccgtacatttttcttcggcgggtgcagcgtcggtggctgcacccgttttttttcgcctggaggaaagccgatgaagattgtcagccgcgaccgctggttcgaagtcagaaacctgagcgacgggattcggctgatccacgagccctatatccggccgttctatcgctgcaacctgtggcatatccagggtcgcgacagggacctgctgctggacagcggctccggcctggtcagcttgcgcgaacagttgccctggctcaccgaacggtccttgctggcggtggccagtcattgccatttcgaccatatcgccgggcatcacgaattccccgaacgcctggtgcacccggccgaggcgcagatcctcgccgcgcccgacggggccaataccttgtcggccgccttcgttggcgatgcgatgttcgaggcccacccggattgcccgctgtgctacgccgaatatcgggtcaaggccgccccggcgacgcgcctgatcgaggaaggcgacgtgctcgacctgggcaaccgtagcctccaggtgctgcatacgcccggccattcccccgggggtatcagcctctgggaagccgccagcggcaccctgttcagcggcgacatcatctacgacggtccactgatcgaagacgcctaccactccaatctggaggactacgccgccagcctgagacgcctgtacgagctgccggtgcggactgtgcatggcggccatttcggcagtttttcgggagcgcagctgcgcacgatgatcgaggattggatccgccagcacccatgaagctgtgctgtactgcacacaatcgcgccatcttcaaagaccatgcgcaggcccctggcgaaaagagccaagatgaaaagagccgaagtccgacaagccgtgcatgacttcatcagccgtctgctcgatggcaacgacggatttgccgacgatgtaagcctgcaggagctggggttggacaagcaggatatcgaggacctgatcttccacctggaagatcagtttggactgaccgccttcacccacgaagaagaccagatgctcaaggcggcgaacagcgccaatgacttgagccggtttctgctgaagatttcacggcactgaagattccatggcgccaagcaccatgggcgggttgcgagttgacgggtttggatcagaaggcggcaaccgttcgcgagtgaacctgccctcgcgcggctgaaaagtgacgggagcaggctggatgcctgccccattcccgagccgatggttagcggcggcgctgttgccgacgccgttgttcgtcgtctgtgcggattggcaccggctgcaatggcggctcgatcagccccagtgcgaccccgaggtcgtgaagccagttttgcagtttctctttcatagtgccccccttaagggtcgtgcctggcggctgggttctgaagccgcttaactctgataatagcgctaactttcgcccagtgctccccccggatagcaatgatctgttaccggattaatccgaatcagccagcccgtttcaggccatcgtccgcagcgctgaccgttgatcggcctgccgcaagcgggtgtcttgccgtcgaggcgacaaccgcttgcccgggaatgccacgccaccgcctgagcctggggttacaacaggttgcgaatccgcctgcgcagccactgttcggcgctgacgaaggtgatgcccagcaacaccagcaccgcgccgatgacgaaattgaggctcaagggttcgcccagcaacagcaccccgaaggtgacaccgaacagcggcgtcatgaaggaaaacaccgccaggttggcggccaggtaacggcgcagcaaccagaaccaggtcaggtagctgaaaaaggacaccaccagcccctggaacagcacgctggccaccgccaccggggtcaggctgacatgggtgacctggccgctcagcgcggcgatcagcagcaggccgacaaaaccgacgatcagctgatagaacagggtcagggtcgctggcgcctcggacaagcgcgacgcgcgcaccaccaccgtggtcgcgccccaggccagaccggccagcacgcccagggcgtcgccaagcagcatgcgcgtgtccaggttatccagcgaaatgccgccggcgaaggccacgccaatgccgatgaacgccagcagaatccccagccactgcaagggcctgaggcgctcgctgggcagcagccagttcacccccagcgcggtgaagatcggcgcggtatagagaaacaccgacatgtgcgccgcgctggtgagcttgagcccttcggcgataaacaggaactccaggccgaacaggctgccggccagcaaaccgccgcgccaggtactgccgatctgcgaccagccgcccttccagcacatcagcaaggccaccagcagcgccgaaatgcctgaacgcgcggccgcctgcatcaccggtgcgacatccgccgcggcccacttgatcatcacctgctgcacgccccagatcaggcacagccccaacatcacttgcagtgcgaaaccatcggcgctacgccgctcgatgctcaccgcagcccctcgggcagattcatagacatggcagttactcgacagaaacgacaaagccccggaaccggtccggggcgaagaatggatgtgctgtcgattatcaaccaaacggacagaaaaacacgcccgaaaaagagcttcgagagaacgagatactcaggtcagttcaatgcggtcggcatgaataacgatctggccattcttgtacaaggcaccgatggccttcttgaagttgcccttgctgacgccgaacaggccactgatcaccgtcggatcgctcttgtcgctgaccggcaaggtgccattgttttcccgcaacttggcgaggatcttcgcgttcaggctgctggccagttcttcgcccaccggttgcaggctgaggctgatcttgccgtcggcgcggatctctttgatgaagcccttttcctgtttgcccggacgcaggaacttgaacacttcgttcttgtggatcaggccccagtgcttgttgttgatgatcgccttgaagcccatgtcggtgctctcggccaccagcagatcgacttcctggccgaccttgtaggtcaccggagccttgtccaggtagcggtccagacgggccgtggcggtgatgcgacgggtgtgcttgtcgaggtagacgtgcaccacgcaatactcgccggcggtcagctggcgcttttcctcggagtacggcagcagcaggtccttgggcaggccccagtcgaggaacacaccgatactgttaacttccacgactttaagactggcgaattcaccgacttgaacttttggtttttcggtagttgcaattaacttgtcggcgctatccagataaacaaaaacattcaaccagtcttcatcttcactgggaatatccttgggaatataacgattgggcagcaatatttcgccatccgccccgccgtccagatataaaccgaagttagtgtgtttaaccacttgcaaactgttgtagcgcccgactaaagccatttccaataccctcattgcgtgggcggcattctacccggttttccgctcctggttggcccgcgtcgccggatagcagcggatattttcctgaatgccttgatttttctggctttgcgccagcaaccggttccgcccgtcaggccagccggcagcgacttttgcctcagcgccgccgagcaagccgctctttgtgccattgtctttatttaaaacagcagcttatggggatattcccgagatcaacttaggattattggggagttttccactgttattccaggaggatatttaccaagcaattgtcaagcatttcatgtatgatggctggccaaattaattttctgaaggttaatggccgccatgcgtgtaaaagcatccaacagcaaagcaaagccagctccagccgttgaaaccagcgaatcgatcaacgatcagattgctgctttcctgaaatccggtggcgagatccagcaaattgccaaaggcgtcagcggccagactttcggcccgtccaagcagatcagcctgggcaagaagtaatccccccgccacacctcctggtccctatgcgctttgagcctcaaagcgctaggactagagttctgacttctcccctcccgtaaaaatcgacgaacggccctcatccccgaggtttcgccggtatcctttcacacgtctagatcgagcattccagtaggttccgcggttcctgctcctcgcgtttcatggagtgaagcatgctcaaaccctctcatgtgctgcttgccagccttctcgccagccccttggtccacgggcagatcttccagcgcgaactgggggacttcgacctcaagctcagcagcaccccgagccgcagcatggcccagggcctggtcaaaccctcggccaccggctcgttccatggtggcctggacctgacccatgacagcggctggtacatcggccagtggtcgccgagcatgggcctgggcgagagcgacctggaagtggactcctacctgggcttcaagcgccccttcgatcagaccctgggttatgaggtggggatgatccagtacaactacccgcaactggccccgcaggatagccaggagctctatggcggcctgacgctgctgggcagccgctttggcgccgcgttcagccaggagtcggacaagcgcaacagcaccctgttcgccgacctgggcggcaaccagcccttcggcatcggcgtcagcatcaagtacaccactcatcagctgggcaacccggtttcggtgagcagcggctacgtcagcagcttcaacgactggtcgatcaagttctcccgcccctggatgggcatcgacctgaaactgatctacagcgactccaacctcaacggcagcgattgttcggcctattctggacataacgcgcaatgcgacggtctgctgaccttcaaggccgagcattcgttctattgagcggctgaactgccggaagctttccgggttcagataagaaacccatgcttacaaacccaggccttcgcaaggacttgccatgtcgcgccggctgcaacacctcaccctgctactgctgttgagtctggttctgacctcctgcaatcgtgtcggcctggcttaccgcaacctcgatgtgatcattccctggacgctcaatgactatctggaaatgaaccgcgagcagaaaacctggttcaacgagcgcctcaaggaacacctgagctggcactgcagcacgcaattgcctggctacctggactacctggaccgtctgcagcagatggtcgcacgcaatcaggtcaacgatgccgagctgcaagagttcacccgcggagccaagcaggccattgcccagaccgcccgcgcgatcgcgccttcggccatcgagttgctgcggggcctggacgaccaacaggtcgcggaaatgaaggcggccttcgccaaggacatgcgccaacgtcgcagcaaatacctcaagccaccactggagcaacagatcaggctgcgcgccgaacgcatggacaaacgcctgactacctggctcggcgccctcactcccgagcagacccagcgggtgacggactggtcaacgtccctcggcgaacagaaccagctctggctcgccaaccgggccaactggcaggcgcagttcagcgccgcgctggagcaacgccagaacagcgacttcgacagacgcatcgagcgcctgctggtggatcgcgaaagcttctggacaccggcttatcgccaggcctacgccaacagcgaacaggcggcgcgcagcctgctggtggacgtgatggccaaaagcacgccagcccagcgcgagcatctgcgcaacaagctgcagaacgtgcgcgatgagttcgatgcgttgaaatgcatgaagaaggtacgccaggagtaacacctggcgcgccttgcgccaacgcattcgctgctgcaaggcatattccccgcagcagcgaacttgctcgcgatgttcgtgatacgcgtcaggcaatctgcgccttgctggccagctcatcgaaaaccgccggttccagcgcatcggcctgttcgtccagcacctggcgcgggtgatcgttgcccggaatgcagctgtcgatcatgcacagcaggctggaaccgcgcggcgtcagcctgaagttctcgccattgccgccttcctcctcgggacgcggctcgatgaaaccccggtccagcaacagtttttcgtactcggcggcggtgcttttcagctcatccagattgcccgtggattcaccctcggccgccttggccgcggcatgctgctcggcatagggtcgcggcgtgaagctgtggcccgcgccgttctgcacctcatgcagcaatcgttcgatcagatcccagttataagtcgccatcctgttctgcctccattcatgaaagagagatgcctgtacccaggttgtgacaaacgccacctatggccgttcagcggcgtcgagcaggcgggcgaccgttgggcggaaccgtccggcggctgtcgatttgcccgcgggcgaaacgactagcctgtgtaggcactgtcgccgcgccacctttgccgcaggagaagacgtcatgcacctcaacgatcatccggtcgtatcccgggaacaatggatacaggcccgcaagcagcacctgattcacgaaaaggcgttcacccgccaacgcgaccagctcagcgccgagcggcgtgccctgccctgggtgaaaatcgacaagccctaccgcttccaggggctccacggcgaactgagcctggccgacctgttcggcgatcgcagccagctggtggtctaccatttcatgttcgccgaaggctgggacgaagggtgcccgggctgctccttcctctccgatcatatcgacggcgccaaccagcacctggcccaccacgacatcgcgctggtggcggtgtcccacgcgcccttcgccgagttccaggcgttcaagcggcgcatgggctggaagttcgattgggtttcgtccgccggctgtgatttcaactacgacttcggggtctgcgcccgggccgacgaggtcgccgccggtaccgccacctacaactacgaaaaaaccgacggcgccgaagaagagctgcccggcctcagcgtgttctaccgcaatgaagccggtgagatcttccacacctactccacctacgcccgtggcctggacctgctggtgggggcctacaactacctggacctgacgcccaaggggcgcaacgaagaacagatcatggactgggtcaggcaccatgatcgttatgacgacaaaccggccgccagttgctgccatggcgggtcctgagcgctatatcgcaatcgcgagccagcctgctgctataggagctggctcgcgatcacgttcgtccggccggcggaaaaaaactggccggcacaaacccgtggcctgccccccggctaaacttggctccatgagccccgcctaccacagcctccacgaatacacccaacgcatgaaccgggtgctggagcatatcgaccaacacctggaccagccgctggagctggcggaactcgcgcaggtcgcacatttttcgccctttcactttcatcgcctgttcaccgcctgggtcggcgaaaccctgggcgattacctgcgccgacgccgcctggcctgtgccgcctatcagctggccagccatccggaattgagcattctggaggtggcgctggaggtcggtttcagctcaggcgaagcgttctcccgggcattcaagcagcacttttcggtcaccccgagcacctggcgcagcaccgaacccaagcgctggcaccgccgcctcagcgacgtccgcgaacggcgcctgcgggaattgagcaatcctgatcagacgcacatcccggccttcgacgatcctgacgccttcattcacctgaaggaactcacgatgaacgtcaccctcaaggaactgcctccagtccgcgtcgcctacctgcgttatatcggcccctacgggccgggcatcggcaccttctggcgcgacaccgtcgccccctggatggtcgaaaacggcctgttgggccgcgtgcgctacggcatcggccacgacgatccctacgtcaccccacctgaaaaatgccgctacgacgcctgcgtcgaagtccccgacgacttcaaggccagcgcccccgccgtcgtcaccaccctgctcggcggcctctacgccatcgcccactaccaaggcaaaggctccgacatcgccgacacctggaccgaactgtgccgcgactggctgcccaagagcggcatgcaattcgatgcccggccagcgttcgagcgctatccggtggacgcgaaatacgacatgaagacgggggaactggagtgtgagatctgtattccggtgaaggcgttgtaaatcataccgacaggcatcagccaccaaggcggttagggttcttgtgcaactggcgcccgaccaccagcaggacaagcaatagcgctggaatgagccgggcggccgcccaccgtaaaactctgaacttttaacctgcgccgtccctcaaccgtcataaccccctgccctgaagccgagacctgccatgaacgctttagtacgtccgctcgtcatcgccaccaccctgctctgcaccctgcctgcctgggcctgcaccctcgacgaggccaccgccaagcgtgagcaactggcccaggaagtggccaggctcaccgagcagaacccggccaaggccaaggaaatcaacgacgagttgcagaagatggacctgagcacggccagcaaggatctgccggacaagtgccagttgatcgaccagcgcctgaaggagctgggcgcggccgagaagaaggccgacagctgatcgccggccaataaaaagcccggacggggtccgggctttttctgttgcgctacggcttattcggcagccggtgctggcttgcggcgcttgagcggcgccatgccgtcctggctgaccaaggcatcgcttttcggccggttggcggtcttgcgcttggtcggggccttggccgcggtttttttcttgtctcccttggcgtcggtctttttcttcttcacgcccgcggccttgccggacgccttgaccttcttcggcccgccgtaggtgcctttgacttccttgatggtgcggcgctcgaagttctgcttgaggtagcgctcgatgctcgacatcaggttccagtcgccatggcagatcagcgagatggccaggccgtcgttgccggcacgcccggtacggccgatgcggtgcacgtactcatcgccgctgcgcggcatgtcgaagttgatcaccaggtccaggccgtcgacgtccaggccgcgggcggcgacgtcggtggcgacaaggattttcaccccaccctgcttcaggcggtcgatggccagcttgcggtccttctggtctttctcaccgtgcaggacgaacgccttgtactcctgggccaccaggcggccgtagatgcggtcggccatggcgcgggtgttggtgaagacgatggccttctggtaggtctcgttggccagcagccagttgacgatctgctctttgtgctggttgtggtcggcggtgatgatctgctgacgggtagtgtcgttcagctggctgaccgcgttgagctgcaggtgctcagggttgttcaggaccttggcgaccatctcgcgcaggcccgagccgccggtggtggcggagaacagcatggtctgctgccggttcgggcactcgtccaccaggcgctgcacgtcgtcggcaaagcccatgtcgagcatgcggtcggcttcgtcgaggaccagcacttccacttctttcaaatcgaggttgccggcgttcagttgctcgatcaggcggcccggggtgccgatcaggatgtccggcaccttgcgcagcatcgcggcctggaccttgaagtcttcgccaccggtgatcaggccggccttgatgaaggtgaactgcgagaaacgttcgacttccttcagggtctgctgcgccagttcgcgggtcggcagcaggatcagggtcttgatgctgacgcggatcttcgccgggccgatcaggcgattgaggatcggcaggacgaacgcggcggtcttgccgctgccggtctgtgccgtcacccgcaggttacgcccctggagcgcgagcggaatggccgctgcctgcacaggcgttggctcgacaaatttaagctcggccacggctttgagcaggcgttcgtgcagggcgaattgggaaaacacgggtgctacctcgaagatatgcaaaaaaacagctgcatagggtaacggtttcgggcgcgaaggccgagtttctttcacgcaaaccacggtaaacaattggtttttgtcagcgatttgtccttaacggtaactttcggcggcttaaatgttctaatcgatccgtctcgtctcatagaggaagcttctgaccccatggatttcaaacagctctggctcaacgttcaagacctctggggggcgctcgatgagcacccgctcctgcattccagcctggccctggttatcctgctggtggtggcgctgctcgtcggacgagtggcgcgctacctgatcctgcacgcggtcaagctgctcggccgccagccgtctctgcactggctcaacgatctgcgccagaacaaggtgttccatcgcctggcgcagatgaccccgtcgctggtggtccagttcggcctgcatctggtgccggagctgagcaagaccagcctggtgttcctcggcaacctggccctggccttcaccatcctgttccaggtactggccatcagcgccctgctcaacgccctgctggacatctacgcccgcaccgaacacgcgcgtacccgttcgatcaagggttatgtgcaactggcgaagatggtgctgttcgtgttcggcgcgatcatcatcgtcgccaccctgatcgaccgctcgccgctgctgctgttgtccggtctgggcgccatgtcggcggtgatcctgttggtctacaaggacaccctgctgtcgttcgtcgccagcgtgcagctgaccagcaacgacatgctgcgggtcggcgactggatcgaaatgccccaggtcggcgccgacggcgatgtggtggatatcaccctgcatacggtcaaggtgcagaacttcgacaagaccatcgtctcgatccccacctggcgcctgatgtccgagtcgttcaagaactggcgcggcatgcagcagtccggcggccggcggatcaagcgcagcctgtacatcgacgccagcggcgtgcgtttcatcaacgatgaggaagagacgcgcctgggcaaggtccacctgctcaccgactacatcagtcgcaagcaggccgagctcaagagctggaacgaagcccagggcaatgtcgccgccatgtcggccaaccgccgccgcatgaccaacctggggaccttccgcgcctatgccctggcgtacctcaagagtcatccggacatccagccgaacatgacctgcatggtccgccagatgcagaccaccgcccagggcattccgctggaaatctactgcttcacccgcaccacggcgtggaccgactacgagcgtatccagggcgatatcttcgattacctgctggcggtgatgccggaattcggcctgagcctgtatcaacagccgagcggcaacgacctgcgcgccggcctgctgccagcggtactgggcgccagccatatccccgaggcggaaaaacgcgcgttgtaatcctgccgatcgccccgtcccccggggcgatcacccctcttattctgctgaagcagcttttgtaccgcgacggctgatccacaccgccgccagaatcaccagcgcccccaggaaaaggcgccccagttcttcgtgctggttccagatcaacaggttgatcagcagccccaccggcacatgcaggttgttcatcaccgccagggtcgcgccagtgaccaggcaggcgcccttgttccaccagtacagccccagcgcggtggacaccagcccgagaaacagcagcaccgcccattgcaacggcgcttcgggcaggaagtccggcttgccgaacagcaggaaagccggcaacaccaccgccagcgcccccaggtagaagtagccgaaacgccggtaatgcggcaggtcgctcggatggcgcgccaccaggtgcttgtacagcacctgcccggcggcgtaggtgaagttggccagttgcagcagcaaaaagcccatgaagaagtccgggctgatacggtcgtagcggatcaccgccgccccggccaccgccaccagcgccgccagcaggccccaggggttgaagcggcggttcagcgcgtcctcgatcagggtcacgtgcagtggcgtgaggatggtgaacagcagcacctccggcaccgtcagcacgcggaaactcaggtacaggcagacgtaggtcacgccgaactgcaaggcgccgatcagcagcatgccgcgcatgaacgccggctccacctggcgccagcgggtcagcgggatgaacaccagcccggccagcagcacccgcaccagcaccgcgaagtaactgtcgacatgcccggccaggtattcgccaatcaggctgaaggaaaacgcctggatcagcgtgacaaaaagtagatagcccatggatcgcctcgtctcgaagggaggcgacgatagcggttttgccccgaataataaaaccggacagacaatatcccgcccctgtaggagcgagcttgctcgcgatgaacgataacgcggtgggccaaacgttccgcgtcgcggctatcgcgagcaagctcgctcctacaggggccgagtcgtcacgaatgggtaggccagcccgccccgggaacgaggtgaaatcgcgggcaaaaaaaaggttcttcacggaatcccgggaaacacagaaacaagaacgccgatttgattgatgatgttcgtgcgagcaaacacatctaacaaaccggcgttcttatgcgtgatattaatactttccttcccttttgggagggcttttctgtcgtcacgatcaagcctgatggtgacgcgctccagatcgatctgattccccacgccacccgattcccttcctgtggcggctgccaaaaactctgttcaaccacgcatgagtactgccagcgagtcatccgcgatctgcccattcttggccgagcagtgcgcctcagcgttttgcttcggcgtgtcggctgtcgggactgtggcaaacgcatggaggccgtcagttggctggatcgctatgcccgcatgacgcgccgcctggccgatgcggtcattcaggcctgcgagcgccttcccacgctacacgtggcccaactgttcgggttgcattgggacagcgttcgcttgctggaacgtcgcgccttgcaagcggcattgagtgttttgccaaaggcgcagccacagcgcttggtcatggacgaatttgccctgttcaaaggtcatcgttacgccagcgtagtgctggacgccgatacccggcgagtgctgtggattggcgaaggccgcagccgggcggcagtcagaccctttttcgaagagctggggtcagagggttgcgctcgcatcgaagcggtggcgatggacatgaacactgcctttgacctggaggttcgtcagcactgcccaaaagcgcgcgtggtctacgacctcttccatgtggtggccaagtatggtcgagaggtgattgatcgagtccgcgtcgatgaagcgaatcggctacgtcacgacaagcctgcccgcacggtcatcaagcaggcgcgatggctgttgctgcgcaatcggcagaacctgaaaacgccggaacaacaagtccgcctggaggatctgctggcggccaaccaagcgttgatgacggtctatttgatgaaggctgaactcaaaacgctttggacaccgagcaccgcctggggctggcgatcagcctggcgacaatggctgcgccatgcgcatgaaagcgacataccgcctctgatccagtttgccaaacgactgaagggttactggcggggcatcgtcagccgggtgcgctggccaatgcatacgggccagttggaaggcatcaacaatcgaatcaaggtcatcaagcggatggcgtacggttaccgggacagcgaattctttttcatgaagatcaagagcgtctttcccggtaatccgtgaagaaccataaaaaaggccaacgctgagcgttcaatcgggcaggagcactcaggagcaacaagtgcaaagggaggttcgatgcgcaaacaaacttgaaggggagcgcagggcctactagaccactgcgcgattatctggcgattaacggatcaggcgacctgggccagtttggcgttggcctggttcaggcccttctcctggaagtcgccgcccaggttcatgccttcggcgtgaatgaactcgacgtcgtggatcccgaggaaacccatgacctggcgcaggtaaggttcctggtggtccgcggtgctgccggcgtagatgccgccacgggcggtcagtacataggcacgcttgccgttgagcaggccctggggaccggttgcggtgtacttgaaggtcacgccggcacgcagcacgtggtccagccaggccttgagggtgctcgggatggcgaagttgtacatcggcgcggccatcaccagcacatcggcggccaacagctcatcggtcaattcgttggagcgctgcagcgaggcctcttcgatctcgttgcgctgcccggcgggtttcatccagccacccagcaggttgatgtccaggtgcggcaccggggttaccgccaggtcacgcacggtgatctggtcgtccgggtgggccgcttgccattgcttgatgaaggtctgggtcagctgacgggaaacggaatcctgctgacgggcactgctttcgatgatcagaacgcgggacatgggatgtagcctccatcgggaatgctgtaggtcgatggagcgcagattaaacagagtcatatcgatgaaaaagcgcaaataactgctataaccaatcaataaattcgtttataagcggagcaggttgcgcaccctgctccgctttgcgcttatttggcggtacaggtcaggtcgatgcgcagcttgatgatgctgcggttgaacttggccgtggcgttcttgaacttgccggccgccacttccaccttgcgcgtgcgcggggcttcgggaccgttgcgaaagaccaccgtgcaggcggcgtcggtggtgccgtagttgttcacctggatcgaaccgatgtcggcatcggtgtcgtaggcggtgtagtcgatgctcacgccttcgaggtgtttcttcacgtcgatgggataggcgaacgcactgagcggcagcagggccagcaacacacaacagaattttctcattcggcagtctccaataaggagcgccagcttaggacaagaggagctcctcatgaaagcgccccgcgttaccctcgatcaatggcgaacgctgcaggccgtggtcgaccacggcggcttcgctcaggcggccgaagcgctgcaccgttcgcaatcctctgtcagttacaccgtggcgcgcatgcaggaccaactgggcgtgccgctgctgcgtatcgatgggcgcaaggccgtgctcaccgaggccggcggcgtattgctgcgccgctcgcggcaactggtgaaacaggccagccagctggaagacctggcccaccacatggaacagggctgggaagccgaagtgcgcctggtggtggacgccgcctaccccagcgcgcgcctggtccgcgccctgaccgccttcatgccgcaaagccgtggctgccgggtacgcctgcgcgaagaagtgttgtccggggtcgaagaggtgctgctcgaaggcgtggccgacctggccatcagcggcttcaatatctccggctacctgggcacggaaatgagctcggtggagttcgtcgccgtggcccacccggaacacgccctgcaccgtctgaaccgcgagctgaacttccaggacctggaaagccagctgcaggtggtgatccgcgactccggccgccaacagccgcgggacgtcggctggctcggcgccgaacagcgctggaccgtcggcagcctggccaccgccgccaccttcgtcggcagcggcctgggctttgcctggctgccgcggcatatgatcgaacgcgaactccgggagggcctgctcaaggtgctaccgttggaccagggcggcagccgccacccgaccttctacctgtattcgaacaaggacaaacccctgggcccggccacgcagatcctcgtcgagctgctgcgcaccttcgacaccgtgccgctggacgcgccgttcgccgccccggaacaagcctgaccccgtactgaaccctccacgcgcctgaacaggaattcagccatggcctatttcgaacacgaaggatgcaccctgcactatgaggaatacggccatggcgaaccgctggtgctggtccacgggctcggctccagcacccgtgactgggaaaagcagatcgccgagctgtccgcccgttaccgcctgatcctgcccgacgtgcgcggccatggtcgctccgacaaacctcgtgggccctacagcatcgccggtttcagcgccgacctcatcgccctgctggagcacctgaacctgtcgcgggtgcacttggtaggcctgtccatgggtggcatgatcgccttccagctcgcggtggatcagcccgggctgctgaaaagcctgtgcatcgtcaacagcgcgcccgaggtgaagatccgcagcgccaacgatgcctggcaatggttcaagcgctggagcctgatgcgcctgctcagcctggaaaccatcggcattgccctggccggcaaattgttccccctacctgcgcaggccgagctgcggcaaaagatggccgagcgctgggcaaaaaacgacaaacgtgcttatctcgcaagcttcgatgccatcgttggctggggggtccaggaacgactttcgcaagtcgcctgtccaaccctggtcatcagcgccgaccgtgactacaccccggtcgcactgaaagaaagttatgtgaaactgctgcccgacggacgcctggtggtgatcgccgattcgcgtcacgccacgccgctggaccagccgcaacgcttcaaccaaaccctgctcgagtttttaaccgcagtcgacaccaccacccaggatcactgacccatgctgaaaaaaatcgccctcgtcgccggctccgttctgttcgctgccaacctgatggccgcccaaccggccaaggcgcctcacgtcctgctggacaccagcttcggcaagatcgaagtcgaactggacccggtcaaggccccgatctccagcaagaacttcctcgactacgtcgacagtggcttctacaccaacaccatctttcaccgggtgatcccgggcttcatggtccagggcggcggcttcaccccgcagatggtgcagaaggaaacccgcgacccgatcaagaacgaagccagcaacggcctgcataacgtacgtggcaccctgtccatggcccgcacctcgaacccgaactcggccaccagccagttcttcatcaacgtcgccgacaacgccttcctcgatccgggtcgcgatgccggttacgcggtgttcgccaaagtggtgagcggcatggacgtggtcgaccagatcgtcaactcgcagaccaccaccaaacaaggcatgcagaacgtgccgatcgaccccgtgctgatcaagtcggccaagcgcatcgactaatgtgtcaccgggagtcccggcgcagcgctgacacggcgctgcgcctgcttactgataaggagagcccgccacgcgggcgtcagatcccatgctctatcgtcgttttgaacagctgatcgatattttccgcgacgctcccactgccgctccccccaaccgcgtactgcccttctacctctactacatcaagcaggtctggccgagcttcgtcgccctgctggtggtcggcctgttcgtggcgctgatcgaggtgtcgctgttcagctacctgagcacgatcatcgacctggcccagggcacgccgaatgtcgagatcttcaagacccacggcctcgagctggcctggatggcggtggtcgcgctgatcttccgcccgctgttcgtcgccctgcacgacctgctggtgcaccagaccatcagcccgggcatgaccagcctgattcgctggcagaaccacagctacgtgctcaagcagagcctgaacttcttccagaacgatttcgccgggcgcatcgcccagcgcatcatgcaaaccggcaactcgctgcgcgattcggcggtgcaggcggtggacgcgctgtggcacgtgctgatctatgcggtcagttccctggtgctgttcgccgaggccgactggcacctgatgatcccgctgctgatctggatcgccagctacatcggcgcgctctggtacttcgtgccgcgggtcaaggaacgctcggtgatttcctcggacgccaactccaagctggtcggcaggatcgtcgacggctacaccaacatcaccaccctcaagctgttcgcccacacccacttcgagcagaactacgcgcgcgaagccatcggcgaacagaccgagaaaagccagctggccggacgcgtcatcaccagcatggacgtggtgatcaccgccatgaacggcctgctgatcgtctccaccacgggcctggccctgtggctgtggacccagtcgctgatctcggtcggcgccatcgccctggccaccggcctggtgattcgcatcgtcaacatgtccggctggatcatgtgggtggtcaacggtatcttcgagaacatcggcatagtccaggacggcctgcagaccatcgcccagcccatcagcgtcagcgaccgcgagcaggcgccacgcctggcggtggccagcggcgaagtgcgtttcgagcatgtggatttccactacgggaaaaaggccggggtcatcagcgacctcaacctgaccatccggcccggagaaaagatcggcctgatcggcccgtccggcgccggcaagtcgaccctggtcaacctgctgctgcggctctatgacctggagagcggtcgcatcctgatcgacaaccagaacatcgccgacgtgacccaggaaagcctgcgcgaacgaatcggtatgatcacccaggacacctcgctgctgcaccgttcgatccgcgacaacctgctgtacggcaagcccgacgccacagacgaagaactctgggaagcggtgcgcaaggcccgcgccgacgagttcatcccgttgctttccgacgcccagggccgcacaggcttcgatgcccacgtcggtgagcgcggggtgaaactctccggtggccagcgccagcgcatcgccattgcccgggtgctgctcaaggatgcgccgatcctgatcatggacgaggccacctcggccctggactcggaagtcgaggcggcgatccaggaaagcctggagaccctgatgcagggcaagaccgtgatcgccatcgcccaccgcctctcgaccatcgcccgcatggaccgcctggtggtcctggaaaaaggccgcatcgccgagaccggcagccatgccgaactgctggcccacggtggcctgtatgcacgcctgtggcagcaccagaccggagggttcgtcggtatcgattgacctgtacctgtagccgctgccgagcctgcgaggctgcgatcggcttgggcggcattccgacgaagcagtcgcaaaccggtgaatgcgctccttcaggcagatcaaggttgcaagatttacgaccgctgcgcggccgatcgcagccttcggcaacggctacagctacccgcccatcgcaggctgcgtcagcggctacagaaaacgccagagcctcgtgaacagggccctggcgttttttttcgcactggatttgtaaaaaaagcctgctgtactgagcctaggttctggaacagggcctgtagccaggctgcacggctgcataacggcgttatcggatcgataaggaataacttctatgtcgctgttcaaacgttcagtcactgagttgttaggtaccttctggctggtattgggtggttgcggcagcgccgtactggcggccgcgtttccggaggtcggcatcggcctgctgggcgtggcgctggccttcggtcttaccgtgctgacgatggccttcgccatcggccatatctccggctgccatctcaaccccgcggtgtccgtcggcctggtggtcggcgggcgctttccgctcaaggaactgcccgcctatgtcatcgcgcaagtgataggcggggtgatcgccgcggcgctgctgtacttcatcgccagcggcaagcccggcttcgagctggccagcgggttgacctccaacggctatggcgaacattcgccagggggctattcactggcggcgggctttgtcagcgagctggtgatgaccgggatgttcgtggtgatcatcctcggcgccaccgataaacgtgcgccggtaggcttcgcgccgatcgccatcggcctggcgctgacgctgatccacctgatctcgattccggtgaccaacacctcggtcaacccggcgcgcagcaccgggccggccttgatcgtcggcggctgggcgatccagcaactgtggctgttctggctggcgccgattctcggcgcggtggtcggcggtggcatctatcgttggctgggcaaggaagacagctgacagcaaccccgagggtcacgcctgccgatacggcagcgcggccctcgcctcttcggcgtaagccagcacgcccgcccgctcctgctggagaaaatccttcaccgccgctttcaagccggggtgtcgcaggtagtgccaggaccgggtaatcaccggttcgaacccccgaatcaacttgtgctcgccctgggccccagcgtcgaaacgctgcaccccctgggcgatggcgtaatccatgccctggtagaaacaggtttcgaaatgcaggcgatcgaattccgccaggcagccccagtaacgcccgtagaagctgtcgccaccgatcaggctgaaggccatggccaccggcctggcgttctgcttggccagcaccacgcgaatggcatcgggcatgcgttcggccagcaggctgaaaaaggcccgggtcaggtagggtgactggcgccgcacggcataggtgttggcgtaacaggcgtagacaaaatcccactgcgcttcgctgagttgccggccttcgagccactcgaactcgatgccctgccccgccacctgttcgcgttccttgcgcatctgtttgcgcttgcgcgagctgagggtatcgagaaagtcctggaagtcccgatagccgcggttctgccaatggaactggcagcccaggcgttcaagccagccggggtgcccggccagggcggcatcagtgaaggcgtcggtgaagttgatatgggcgctggaaagcccttcgatctccaggtaaccgggcaggctttgcagcagttcgaagccgtcttccaggcttgccgccagcagccgcgcgccgctgatcgggctgaagggcacggcgctcagcagcttggggtaatactcgatgccggcccgggcgcaggcgtcggcccagccatggtcgaacacgtactcaccgtaggaatgccacttgcggtagctgggcagcgccgcgatcaggcgtccgtcttgcacatgcagcaggtgctcggcctgccagccagagttcgggccgaggctgccgctgtcttccagcgtgctgagaaaggcgtgacgcagaaacggctggccgtcactgagcaaaccgtcccattgctgcggatcgacggcggccaggctggtcaaggattgcaacggcattgggttccccgcgagtgtggtccacgaacgcgccgagtatcgccgatcactgccccaggtgcagcaacaggaaatcgatgaacgcccgcgacttgtgcggcaggtgcgaactgttgggaaacaccacgttcaccgactgcgaaggcaaggcgtagtcgggcagcaggcgcaccagccggccgctggccaggtcgtcctcgaccacccagccggggagtaccgacaccccgagggacgacagggtcatggcgcgaatggcggtggaggagttggattcgaaatgattgggcccgctgacttcgacctggcctcgttgcgggtggctcaaggtccagttggtcggcccttgcaggttgctgttggcgatccacggcacgttgttcaggtcctgtggctcgcccaccggatgacgcgccagaaagtccgggctggccaccaggacgatgtcgtaatcggccagcttgcggctcttgaaagccgagtcggcgaggttgcccaggcggatcaccaggtcgagtttttccgccaccagatcattcaacgaagagttgaagttataacaaagacggatctccggataacgctcggtgaacttggaaatgatcggcagtatatagcgctcgccatactcactagttgaactgaaacgcaactttccagaaatacgattatgcccatgcaggacattctcgaaggcattgtcgatatccgcgacaatccccttgaactcgttataaaagtcctggcctatttccgtcagggatatattgcgggtattgcggatcaacagggtcgccgacaaaacttcctcgagcgccttgacatgcaggctggccatggctttgctgatgcacaggtagttggccgccttggtataggaaccgaaatcgacaaccgccaggaatgtctggacgcgatttagatgcgtgtgcatgttatagctcaccgtgttgtaaatcattgtcaaattccaccaaacaatgtttcaagtataggcgtatcgacaccctcggtctatcgctcctatgatcccgccgcaaaagggagatcatatgacttatcgctacaaagtggctcttatattcctcatcggattctttatcgactgtataaacatattcatgtcggccgtggctttaccgagtattgcccatgagatgcacgtctcgacttcatccgtggcctgggtggccaatgcctatattctcggcctgaccctgatcattccggtgagcacctggctggccggacgtttcggcagccgcgaaaccctcaccgcctcgatgctggtgttcagcaccgccgtgtggatgtgcgggatggccggcagcttccatgaactggtgatctggcgtttcgtccagggtatcggcggcggcctgctgatcccggtgggccaggccctgaccttcaacctgttccagggcccgcagcgggccaagatctccaccctggtgatggccgtcgccctgatcgccccggccatttcgccgaccatcggcggcgtgatcgtcgacagcagctcctggcgctgggtattccacagcaatattccgttctcgctgatcgccgccgccctgtcctggctgtggatcaaggaagcccggcccgccagcctggcgcgcccggacatcaagggcctgctgctggtcagcgcggccctgggcagcctgctgatgggcatgtcgctgtacggcggcgactacccgccgctggccgccctgagctgcctgatgctgggggtcacctgcgtggtgctgtatgtcctgcactaccgccgctgcgacaatgccatcgtcgagttgagcctgctcaagagcaagaagctcagtacctcgatcttcatctattacgcgattcccggggtgttcaccggggtcaacctgctgagcatcttcttcctgcagaacagcctgcacttcagcgcccagctgaccggcatgttcatgatcctctacgccagcggcgccttcatcgccatgctggtctgcggccgggtctacaaccgcttcggcgcccggcgcctgttcaccctcggcatgctcctgcacagcgccggcatcgccaccctgtacctggtcgacagcgccgccgacctgccgatcatcgtcatcgcctactgcctgatgggcatcggcggcggcatcggcgccaataccgcgcaaaccacttcgctgatggatttcgaaggtgccgatacccacaagggcagcgtgatctggaacatcaaccggcagatgtccttcagcatcggcgccgcgctgttcctgatgatctacaacctgctgctcgcccgcctggcgtctaccccggcctatcacctgaccttcgtcatcgcggcggtgatgggtctgttacccctgttgcagatgagcaacctgaccacgcaaaaggaatgtcatgcacaacacaatcgttgaacaggccaaacacagcatccatgcggtccacgacctgatccacgcggtcttcaccgaccaggacggcaacggcgccgccgccatagaccgactgctgccggccttcgccgagcacttcagcatggtcaccaccgcgggcgccatcgtcagccgcgcgcaggtagaacagatgttccgcggcgccgtcggtgcccgccccggcctggaaatcctcgtcagcgacctgcacaccgtgtggcacgaaggccacagcgcggcgatccgctacaaggaaacccatcgcctggaccagaaggaaacctcgcgcctctcggtggtggtgatccgcatccatgagcactcggcccagtggctgtacctgcatgaaacaccgttaagctgacagcgagtcaccccatgaattaccagatcacccagtgcctgatgctctcgccaagcatcaaggaaatcactctggcgcctcttgtgccggccccctgcgagaccaccgccggggcccacttcaaatggtggattcccacgctcgagcaatggcgtcactactcccgggtcgaactggccgaacatgagctgccccagggcagcctggtgttcgccatccgcctcaaccccgactcgctcagcagcgcttatatccgccagttgaaggccggcgacccggtgcggctcgacggcccgttcaatgccttcgactaccagctggacgacagcgacggcgccgacatcgccctcgccggaggcatcggcatcaccccgttgaccggcatcctcgggcatctgcgagcccggcagcgtccggcgcggctgcactatttcgccaagagcgcgggcgacgccgcctatgccgcgcagatgcgcgaactgctgcaggacagcctgagcctgcactgctccgactcggccgaagggcgcccgtcggtggccgcggtgctgggccagttgcaaccccgggaccgcctgtatgtgtgcggcccgcaagccatgctcaacgacgtgttcagccatgcccagagcctggggtttccccgcgagcgcatccacttcgaaatcttcaacacctgcctggccgaggatgaccccggcttcgccgtgcacgccgcggactccggcgtcgacctgcgggtgcagcccggccagtccctgctcgacgccctcgaagaggccggcctggagccgctctacgactgccgtcgcggcgaatgcggggtgtgcgagctggacgtgctggaaggtgaagtcgatcaccgcgatttcatcatgagcccgcagcaggccgcctgcagcaacaagatctacccctgcgtatcccgggccaaaagcccaagcctgaaactggtcatctaaagagagaacctcgttggacaactacttcaacggcaaggaagtgcatcgcacgctgttccttgatccgtcgctcttcgagcgagaacaacaacaggtattcgccgccagctggtgctacctgggccatgaaagcctggtcccggaaaccggcgacttcttcaccggcgagatcgccggccaaccgctggccatggtccggcagaaaaacggcgagatcgtcgtgctgcacaaccgctgcccgcacaagggcgtgaaagtgctggccgagccgcaaggcaatgtcgggcgctttatccgctgcccctatcacgcctggaccttcaagaccgacggccagctgctgagcatcccggtgaaaaaagaatacgacgactgcgacctcagcagctgcgccgcccacaagggcatgcagccggtggcggcgatggagaactaccggggcttcgtgttcgtgcgcctcaaggagcaaggcgtcggcttcagcgagttcttcggcgactcgctgtcgaccctggacaacatggtcatgcgctcgccccaggggcagttgcgcgccatcggccagcccttgctgcaccgccatcgctgcaactggaagatggtggtcgacaaccagaccgacacctgccacccgatggtcgcccacgaatcctcggccggcgaagccattcgcctgtggaaggaaaccgggcacgacggccagccgccgatggccgtggaactgttctcgccgttcatggcgtcctacgagttcttcagcgccatgggcatccgcacctggcccaacggccatggccacaccggtgtcagcaactcgatccacaaggcctattcgagcattcccggctactgggagctgatggtcgagagctacggcgaaacccaggccgcggcgatcctcgacgacacccggcacaacaccgtgtatttccccaacctgatggtcaagggaccgatccagaccctgcgggtgatccgcccgatctcggccagcgaaaccgtggtcgagtcgtggatcttcgaactggtgggcgcgccggtgcagctgctggaaagaaccgtgcagtacaacaacctgatcaactcgccatgttcgatggtcgcccacgacgacgtggagatgtacgagcgggccatggacgggctgcgcagccaggccaacgactgggtgaatgtcgcccgcctgttcgaaccgggcgaagcctttgaacagacccaggtggtgtccggcaccagcgaacgggccatgcgcaacttctacaacacctggcagcaactgatgcaggccccagacggatcgaccgcccatggataactcgcccctcgaacagctgatctaccaagagatcgcgcttctcgaccaacaggatttcgacgcctggcaacagttgctgtgcgacgacttccactactggattcccctgcgccacgaccaaccctgcccgttgcgcgaatcgtcgctgctgtatgaggaccgcttcctcaccactctgcgcatcaaccgcctggccagcgcccgcaacttctcgcagcagcccaagagccgcggcctgcacattgcccagcggccaacgatcagcctcgatgcggatggcctgagtgcccattgccggacccccatgctgtattgcgaagcccggggcgacagcgaatggcattacccggtgaccgtggaacaccaactgctgtgcctcgccggccagtggaaaatccagcgcaagaaagtcctcctgctcaatccgtcccgcgcgtttgaaagcctgcagctcatcatctgatttccgagacccttacctgtgaactcctcccactccggtttcgaagaaacccaaggcacccgctcgttccccaacatcgacctgttgtacgactatgggcaattcctgcgccgtgccacccaggccatcggtcacctgccgccagcgatcgccgacaagcacgtcggtatcgtcggcgccggcctcagcggcctgatcgcggcctatgaactgctgcgcgccggcgccactcgcatcaccctgttcgaagcctcgaaagaccaccttggcgggcgtttcctgacccagtgcttcgacgaaacacaaccgcagttcatcgccgagatgggcgccatgcgtttcccgccgagcgaagtcggcctgttccattacctggaccgcttcggcatcggcaccactgaggccttccccgaccccggcgtggtcgacaccgaaatccactaccgcggcgaaacccaccactggccggccggggaaaatccaccgccgatcttcaacaccgtgcaccggggctggaacgcctttctcaaggaaggcgtgcgcctggacgacggcaccttcctggcgccgccgctgctactcaccgagctgctggaaaagcagcaatacgccgaagtgcagccggagtggcaacgctacctggactgctttggcgaccactctttctactcggccatggtgcagatcttcacctcgaaaaacccgccgggcggcaagcgctggcgcaagccggaagacttccacctgttcggttccctgggcatcggctcgggtggtttccagtcggtgtaccgggcctcgttcaccgagatcctgcggctggtgatcaacgccttcgaagtcaaccagcggctggtgcccaatggcatttccaccctctgggagcggatcgccgacgaggaattccacggcatcgccctgcgcgaccggatctgccgcacccgcatcgaatccatcagcaagggctccgacgggcagatcctgctgcaaggctgcaacggtgaaacctatggctgcgaccgggtgatcaccaccgccaccacccgcgccctgcaagtcaacatgcgcctcacccaggccgagcagttcgtcaatcgcgacgtggcccgggcgatcaacgaaacccatatggtcggctcgtccaagctgttcatcctgacccgcgacaagttctggctcaaacatggcctggcgcagaacatccagaccgacaccctggtcaagggcgtctactgcctggactacgccccgcaggacccggactcctggggcgtggtgctgatcagttacacctgggaagacgactcgcacaaaatggtttcgatgaccgacaaggtccagcgctgcaagcgcctggtggacgaactggcgatgagcgcgccgcagttcgctagccatttggtaccgctggacggcgactaccagcgttacgtactggaatacgactggctcaccgacaagcaggccctgggcgccttcaagctgaacttcccgggcgacgacctgtactcccagcgcctgttctatcagttcaagaccgccctcgacccgcagcaggacaccggcctgtacctggccggctgcggcagttcgtttaccggcggctgggccgaaggcgcggtgcagaccgccctgaacggcgcctgtgcggtgatcgccagcctcggcggcgaactgctggaaggcaacccgctgttcgatctgcaatcgcacttccgctattgctgagcccaggcccctaccgactttcgttgagactttttcatgtacagccagcattcgatcgaagcgctcgttgacgggtttcgccagggcagcctctgcctggattcctggcaccgcgcgctactcgagcaatacgccgacgccaggcacctgaacagcttcatcagcttcgccgcgcaggcgttcagcggcgacaccggcacgcccgagcagcgccaggcgccgctctacggcatcccggtttcgttcaaggacaacatcaatgtcagtggcctggcgaccaccgccggcacccctggcctggccgactaccacccggccgcggacgccggcattgtccggcgcttcaggacgctgggcgcgcgggtcgccggcaagaacaacatgcacgagctgtcgttcggcgtgacctcggccaacctgagctacggcgcggtggtcaatccgcgccacctgcaacacagcgccggtggcagcagcggcggttgtgccgcggccgtggccgccggcctggtgccctgcgcggtgggcaccgacaccggcggctcggtgcggattcccgcggccttctgcggcgtggtgggcttccggccaagcaccggggtctaccctggcgacggcatcgtcccggtgtcccagaccaaggactcaccgggcctgctgacccgcagcctggaagacgcgctgttcgtgcatcggcatctgaccggcgcgtcctgcgccgcgccgaccgagcccaagcgcctgcgcatcggcattccccagcggttcttctggtccgagctggaggccaaggtgcacagcgactgccgcgcggcgatcgattgcctggccgatcagggcgtggagatggtgccggtggacgaccgcctgatcggcgagatcaacgaaagcatccagttcccgctgccgatcttcgagttcttcatcgacttcccgcgcttcctgctgaaggccggctgtggcgagcggttcctcgagatcctggcgcagatccgcgacccgcagatcaagaagaccctgatggcgcagttggagagcccggccatttcctacgaggactacgtacaggccttgatgagcaagatccgcctggatcgcgaatacgccgggctgttccagcagcaccggctggacctgatcgcctacccgaccgtcagttgcaccgcgccgctgttgagcgacagcggcgcccaggagcatttcgagcgtttcgtgcgcaacaccgacccggccagcaacctggcggcgccgagtgtcagcgtgccggtggccgagccgggcagcctgccggtcgggctgtcgttcgacgccttacccgggcaggaccaccagttgctacagatggcgcagcaactgggccgcctgctggctctgcgctgattcagcgcccgagtgcgcgggagccggcctgccggttttccgcacacccgaggcgccccctcgctacctccaataacaatttcattgcaggccttgccatgcgcggtacgtccatcgcttcatccccttcaacctcccactgcacggtcgccgaacgccggccttcggtcatcggcggcgccatgattatcggcggcaccattgtcggagcgggcatgttctcgctgccggtaatgatgtcgggcctgtggttccaaggttccctcgcggtgctggcgctgtcgtggttctgcaccctgcactcggggctgatgatcctcgaagccaacctcaactaccggccgggtgcgagtttctcgaccatcacccgcgacctgatcggccggcgctggagcctgttcaacggcgccaccctggtgttcgtcctgtacatcctgacctatgcctacatctcggccagcggctcggtgatccgtcataccgcccacaacctgggcctggagatttcctcgcgcaacggcggcctgctgttcgccctggcggtggccctggtggtctggctcagcaccgcggcggtcagtcgcatcaccaccctggtgttcggcgccaagatcctcgccttcttcctgaccttcggcggcctgctcggccaggtgcagccacaggttttgctcgatcgcggcaacccgcaaccggactacctgccctatctgttcatgaccctgccgttctgcctgacctccttcggctttcacggcaacgtgccgagcctgatgaagcactacggcaaggacccgcagcgcatccgcaactgcctgctgatcggcaccctgatcgccctggtcctgtacacggtgtggatgctctgcaccatgggcaccctgccccgcgagcagttcaaggacatcgcccgccagggcggcaccatcgatgtgctgatcagcgccctgggcagcatgctcgacagcgcccgggtcgacctgctgctgaccctgttctccaactttgccgtggcctgttcgttcctcggcgtcaccctggggttgttcgactacatcgccgactccctgggcttcgacgacagcccccaaggccgcctgaaaagcgcgctggccaccttcgccccaccgatcggctgcgcgctgatctggccggaaggcttcatccttgccatcggttttgccggcctggcggcgactgtctgggcggtgatcaccccggccctgctcgcccgcgcctcgcgcaagcgcttcgccagcccgctgtaccgggtctggggtggcacgccgatgatcgtcctggtgctgctgttcggcctggccaacgccctggcccacctgctgttcagcttcgacctgctgccggtctggcgttagccgaatggccgggcaaaaaaaagccccgccggagcggggctgaaacgaaaggagctttaacggatgaggaagagctctttacagcggtaaatgaaccttagaacacgtactgcgcgcggacgatgaagccgtcgccgtcgtcgtcaccggtacgcgcggctggagtaccaccgctggcggccgtggcgttggtgaccttgtcggtcttggccttgacgtaggtggcggagattttcaccgcttcgttggcgtaccagttcacacccaggttgtgcaccttgacttcggcatcgccgacgtcgcgggtcaggctggcggtggtgatgttgtcgtcttcgacggtcatgctgtcgtagcgatagaacagttcccaggcaccgaaagccttgttggccggcttgatggcgtcgaacttgcccaccttgtagccgcgggattcgccggtcagggtgtaagcgccctgcacgtagaagccgtggcccttgatgtcttcgtaggcgttggaatcagccttggtcttgcgggtgatgtattcaccctggatcgaggccgggcccatggcgaacgcggcttccagacccagcgcggtgtcgcggtcgaaggaaccggccggcgaagtcgagctgccgcccagcaccggacggttgccgttggtgccggcatcgttgccgcccagggtctcgacgccacgcatgcccatgcgggtgcgataacgggagtcgaacgcagtgtcggagacatcacgcgaagccacgttcacaccgaagtgcaggacgttgccggcatcgtgcatcggagcgaagacgaagcgaccgttgacctgcttgacgctgtcgccgtcggtgtcgtcggtgtccttgctgaacacgccggccgaggcatagaaggaatcggcgaaggtgctggaagcctgcaggcccaggccattctggtgggtgttggcccagtcgaccatgtcgtaggcgatgttacgttccggcgcggtgacccacttggagctggtggctttttccaggccgaagtccgggtcgaagcgaccgaccttgatcgacaccggcttgaagccgttgtaagccagcgaggcttcgtcgaagtagccgttatcggagtcgccggtgttgtgggagaagtcgtagttgatggtgtaggcccagtcggtgtacagcacgccggacagttcgaggaaggcgcgacggaagtaagcggcgtcggcggtgtcaccgttcttggtgtagacaccgtcgaagcggctgtagtcggcttgcaggcggccaccgagcttgaagctgaactctttgtctgtggtggcgacctcaaggccgcccttggtcttgactacgatatcggcgccatcggtggtaacggtgccagcgaaagcctgggcggtaactgccagggccagggcgctggcggcaaaaccggcgaagtgcttacggatcatcgaagatttcccctaattggtggtctgtagcgctggaaaaaacacgcgagtcaggcccgcttgtgttgggagggaatcttggcggcgggttatttcaggggagttgccgatagataaagatttgatgacagcggaacttttttacttccaaacgaaataaggcaaaaagcctgtactagagcgctcggcggggtatttggggaaaaacgaaaaccctgtagccgctggcgaagcctgcgatcgagcgcgaagcggtcgcagcgacttcaagatcgctgaaggccttcggccttatcgcagcctgcggcagcggctacaggaactcgtacaccgtgcaggcgttggtgtagccgctggcgaagcctgcgatcgagcgcgaagcggtcgcagcgacttcaagatcgttgaaggccttcggccttatcgcagcctgcggcagcggctacaggaactcgtacaacttgcaggcattggtgtagccgctggcgaagcctgcgatcgagcgcgaagcggccgcagtgacttcaagatcgctgaaggccttcggccttatcgcagcctgcggcagcggctacagaactcgtacaccttgcagacgttggtgtagccactggcgaagcctgcgatcgagcgcgaagcggccgcagcgacttcaagatcgctgaaagccttcggccttatcgcagcctgcggcagtggctacaggaactcgtacaccttgcaggcgttggtgtagccgctggcgaagcctgcgatcgagcgcgaagcggtcgcagtgacttcaagatcgctgaaggccttcggccttatcgcagcctgcggcagtggctacaggaactcgtacaccttgcaggcattggtgtagccgctggcgaagcctgcgatcgagcgcgaagcggtcgcgctcttgagggcctcgaggcttcagcggctacgggaggattgtcgggtgaatcaggtgttgcgcttgcgctcggcggccaggcgttcggccagcgcatcgatatcggccacgggctcttccggcatcttgcgcaaggtggcctgcatcaagcgcatctgccgcaggaaacgccggcaattggggcagaacaacaggtgatggcgctggatcaggcgctggcgaaagctcagctgaccatcgagatagtcgctggagcgtgccacttgttccttgcaggtcagcattggccggtctcctcgaagtgctccacggtggcaaaaatcttcagccgcgcccggtgcagcagcacccggacattggagagggaaatgtccagaagattacagatctcctccagctccaggccctggcgctcgcgcagggtcaacacgctgccttgcagttccgacaagctcagcaaagtgtgctccaggcattcgcgcagctcagcctcggtgagcagggcttccggggtatcggcgtgccaggcgaacggcgccaccagccagtgcccgtcagatgaagaaaaacgctcgtcgccgatggtgccgtggggtgccggcaagtcatccagcaggacttcacggcggttctgtttgtagcggcttttcgccgagttggcggtgatggtcagcagccaggtcttgaggctggaacgcccctggaaaccggccaggttgcgcaccaccgacagccaggcatcctgcaccacttcgtcggcgtggcgctggccgacaatggcgtaggccacggcgcgcatcgcgctctggtaggtgctgaccagttccttgtaggccttttgctcgccggccaacaggcgttcaagcagttgcgtgtcgtcagctgcggacattcatgcctcgtaatcggaatccaggatcgcaaccgctgaatcagcggctgcgatccataagactgtcaacgcttgcgcagaagcacactgccaatcgaataaccggcgccgaacgagctgagcaccgccagcgagccgccgggcaggtcgtcctggttcttgtggaacgcgatcaccgaaccggccgaactggtgttggcgtaggtgtcgagaatcaccggtgcctcctcttcggtggcctcgcggcccagcagcttcttgacgatcaggtggttcatgctgaggttggcctggtgcagccagaaacgcttcacgtcgctgacgttcagctggttttcctgcaggtgctcggcgatcagttccgccaccatcgggcagacgtcgcggaacaccttgcggccttcctgcacgaagagtttgtccggcgcgccgatgccctcttccgcggcgcggttgaggaagccgaagttgttgcggatgttgttggagaacttggtcagcagcttggtgctgatgatgtcgaactggtacggcgaggtggccaggtcagcccgttcgataatcaccgcggtggccgcgtcgccgaagatgaagtggctgtcgcggtcacggaagttcaggtggccggtgcagacttccgggttgaccatcaggatcgcccgggcctggcccagttgcacgctgttgcaggccgcctggatgccgaaggtggccgaggagcaggccacgttcatgtcgaaaccgaaaccttcgatgcccagggcttcctggacttcgatggcgatggccgggtaggcgcgttgcaggttggagcaggcgacgatcaccccgtcgatgtccgcggcggtcttgccggcgcgttgcagggcctgttcggcggcgccgatggccatctggcagagcaccgaccattcgtcgttggaacgctcgggcaggcgcggggccatgcgctgcggatcgaggatgccgtccttgtccatgacaaagcggcttttgatgccggaggccttctcgatgaaggccgcgctggattcggtcagggcctgaacctcgccgcgctcgatcgcttgcgcgttgtcggcgttgaactgatgcacgtaggtgttgaaagactccaccagctcttcgttggagatgctgttggccggggtgtacaggccagtgccgctgatgacgacgttatgcacggtcgttcctctattctgttcaggcagaaggtattggcaccgtcgtaccaaaccgtaaatggtctatcccgactggcggaacaggacctgacatcgctttattccgctttgcccgggcggcgaacgctcaaaaccgcggggccggcatttataacggcgaagtttgccataaacgccggcgtttggccccatcggcaagcgtagtcggcgcaacatcgccgatcctgtagccgctggcgaagcctgcgatcgagcgcgaagcggtcgcgctcttgaggccctcgaggcccctgcggggccttacgcagcctgcggcagcggctacagcgcgtcaggcttccacctggctccactgcttgttcaggcgcttgtcggaaatcggcgccttggtgcccaattgctgggcgaacagcgagacccggtattcctccagccaccagcggtacagctccaactgcgggtcgcgcttgccttcctgggcatgtttgctcgcccgcgcctggtactggttccacaggccggccagctcagtactccagacccggtccttctgcacctggctgccgagtttctcgaaacgcaactcgacggccttgaggtaacgcggcagttccttgagccactgcgccggggtctcgcggacaaaccccgggtacaccagatggcttagctgcgacttgatgtcgttcagcgccaccgcctgggccagatcgatcttgcccttgaaacgcttttgcaggccatgccagagcttgaggatctccagggtcaggcgcgccaggcgctcggcgtgctcggtccagctgccgcgcttgcgctcggccagcgacgccaggccggcgccatcgcgcggcaggctgtcctcgccttccagcacgcagctgtcgaggctggccagcaggatgtcttcctccagggcatcgacgcgccccagttcgcgatacagcaggcccagctcggtcagccccggcaacttgttgcgcaggaacttggccggctcggccagctgttgcagcaacaggcgctgcaaggcgcggcgatgctggaactctgcttcggccggggtcgagaaacgcccctccttgacggtcccgccttcttctaccagcgccggatacaccgtcatcgacagcccggcgatcttctgttgggttttctccgccaccgcggcgaacactttggcctccaccggctgctggcttttcgcggtttgcggcacggccagggcggcctggctggcctcggcgaaacgcgcggtcagctcggccaggtcgcggccttcgccgaggaacttgccctgggcatcgacgatttccaggttcatccgcaggtggctttccacctgttgcgccgactcggcccaggcctcgtcgctgacccgcgccccggtcatgcgcagcagttcgcggcccagggcctggggcagcgagccctgggcgaagtcgatacgcgccagggccgccttgacgaagtccggcaccggtacgaagttcttgcgcagcgccttgggcaggttgcgcaccagggcgatgcacttggcttccaccagccccggcaccagccattccaggcgctcggcgggcaaggccggcagcagcggcgccggcacccgcagggttacgccgtcccgtggatggttgggctcgaagtggtaactcagggccagttccagatcgccgatctgcagggtgtccgggtactgcatggcggtgacttcgctggcctcgcgggccagcacgtcttcctcgcgcatgatcagcaactgcgggtctttctggctatgcacccggtaccagctgtcgaaggtcgcggtctggtggatctccgccggcaggcgcgcgtcgtagaaggcgaacagggtttcctcgtcggcgaggatgtcgcggcgccgggccttggcttccagttcgtcgagctgctcgagcagccgtgtattagcgctcaggcacttggctttcgactggatctcgccacgcaccaggccttcgcggataaacagctcgcgcgacaccaccgggtccaccgggccgtaatgcaccgggcggcggccgaccacgatcaggccgaacagggtgatctgctcgtaggccaccacctgcccgcgcttcttctcccaatggggttcgaagtggttcttcttgatcaggtgcccggccaacggctcgatccagtcggcgtcgatcttcgccaccatgcgcgcgtagagcttggtggtttccaccagttcggcagtcatcagccattgcgggcgctttttgccgatccccgacgacggatgaatccagaagcgccgctggcgggcgccgaggtagtcgccctcctcggtcttctggccgatctggctcagcagcccgaccagcaccgccttgtgcagcttcggataatcggccggttccttgttcaggctcagttgcaggtcgcggcagatcaggctcagttggcgatgggagtcgcgccactcacgcaggcgcaagtagttgaggaaattcttgcggcaccagttacgcagcgggctggcggtcagcgcctggcgctgctcttcgaagccgcgccacagattgaccagcccggcgaaatccgagtcggcgtccttccactgcgcgtgggcctggtcggccgcctgctggcgctccggcggccgctcgcgcgggtcctggatcgacatggcgctggcgacgatcagcacttcctgcaggctgcccagctttgccgcttccagcagcatgcggcccatgcgcgggtccaccggcaggcgcgccagctggcggcccagcggcgtcagctggctgttgcgatccaccgccgagagctcttgcagcaggttgaaaccgtcgctgatggccttgccatccggcggctcgataaaggggaacgcggtgatttcaccgaggcgcagatggagcatctgcaggatcaccgccgccaggttggtgcgcaggatttccgggtcggtgaattccggacggccgttgaaatcctcttcgctgtacaggcgcacgcagatgcccggctcgacccggccgcagcggcctttgcgctggttggcgctggcctgggaaatcgcctcaatgggcaggcgctggaccttggcccgatagctgtagcggctgatgcgcgcggtgccgctgtcgatcacgtagcggatacccggcacagtcagcgaggtctcggcgacgttggtcgccagcactaccctgcggcccgggtgcgactggaaaatccgctgctgctcggccggcgacaggcgcgcgtacagcggcaggatctcggtgtgcttgagctgggccttgcgcagcatttcggcggcgtcgcgaatctcccgctcgcccggcaggaacaccagcacgtcacccgggctgcggcgctcgctgcgctcatgggcggcgatttcatcgagggtggcgaggatcgcctggtccaccgtcaggtcgtcctcgacccggttgccctcttcgtcctgctccagggtcagcgggcggtaccaggtttccaccgggaaggtgcggccggagacctcgacgatcggcgcatcgtcgaagtgcctggagaaacgctccaggtcgatggtcgccgaggtgatgatgaccttgaggtccgggcgccgcggcagcagggtcttcaggtagcccagcaggaagtcgatgttcaggctgcgttcgtgggcttcgtcgacgatgatcgtgtcgtagcgttccaggtagcggtcgttctgggtttccgccagcaggatgccgtcggtcatcagcttgatcagggtattggaatcgctctggtcctcgaagcgcacctgataccccaccagggcacccagcggcgtcgccagctcttcggcgacccggctggcgacgctgcgcgcggcgatccgccggggctgggtgtgaccgatcaggccgtgctggccgcgaccgatttccaggcagatcttcggcaactgggtggttttgcccgagccggtttcgccagcgatgatcagcacctggtgcttttgcagcgccgccttgatctcgtcgcgcttggcggcgatcggcaggctgtcgtcgtagcgaatcgacggcacgctggcgcgccgcgtcagcacctgggcgcaggacgcctgcatgcgctcgacccactgcgccaacttggcctcgtcgggcttcttgcgcagctcaagcagctgccgacgcaaccggtggcggtcggcgagcatggcgtggtcgaggtttttcagcagttggtcgattgcaggcgattcggaagtcatcgggtacgcaagggtcgtcttatttatgcagggggcggattgtcgcagatttaacgagcgaacgagattcttgtagccgctggcgtagcctgcgttcggctgcgaagccgccgtaaacctgcttcccgagtattactgatgtaccgcgagcacccgttttgcgaggactgcgtcctcggacgcaggattagccagcggctacaggggcgcgcggcgctggcttattcgctgtcccggtccttgcgccggtacgggaacacatcgatcaccttgccggcgcgaatggcgtcctgcaggcctttccagtaatcggcgttgtacaactcgccgtgcaactggtcgaacagcttgcgctgcccggcgtcggcgaacaggaacggtgggaactcctcggggaacacgtccagcgggccgatggaataccagggctcggaggccatctcgtcctccggggtacgcggcgccggaatgtggcggaagttggcttcggtgaggaagcagatctcgtcgtagtcgtagaacaccacccggccatggcgggtgacaccgaagttcttcagcagcatatcgccgggaaagatgttggccgcggccagctgcttgatcgccaggccgtagtcctccagcgcctcgcgcacctgggccgggttggcgttatccaggtagaggttgagcggggtcatgcgccgctcggtccagcagtggcggatcagcaccgtatcgccctccaccgacaccgtggacggcgcgacttccagcagttccgccaggcacgcggggtcgaacttgcccaggggaaagcggaaatcggcgaactcctgggtatcggccatgcgcccgacccggtcgacgcttttcaccaggcggtacttctcgatcaccgtggcgcggtcgacgtttttcgacggcgagaagcgatccttgatgatcttgaacacggtgttgaagcccggcagggtgaacacgctcatgaccatgccgcgcacgcccggggccatgatgaactggtcgtcggtgttggccaggtggttgatcagcgcccggtagaactcggacttgccgtgcttgtagaaaccgatggaggtgtacagctcggcgatgtgcttgcccggcaggatgcgcttgaggaaaccgatgaactccgccggcaccggcacgtcgaccatgaaataggagcgggtgaaggaaaagatgattgatacatcggcttcgtcggtgatcagcgcgtcgatctggatcccccggccttcgcggtgcagcagcggaatcaccagcggccactgctcgtcgtgggtgtagatgcggcccaccaggtaggcgcccttgttgcggtacagcaccgaggaaaacaactccaccgccagctccgggtccttgcacacccagtccggcaggttctcccgcagctgcgactccaggcgccgcaggtcgccgggcaggtcggcgtaggcttcgctgaagctgtagtcgacgaagatctgttcgagcatcgtcgacagatgaccttgcggccggtaggtgcgggtctgcgcggcccgggcgcggcgcaggctcggccgcgtggtgtggatgaacatgcagccgtcgctgatcaggtcatggctgaacaggccgcagaaggccgagttgtaccaggtctcggacagctcatcgtcgaagcgcaggtcgatcaggctgatataggcgcttttcaccagcggccactgattgacgtcgagcagggtctccaggtcgaaggtcgcgcgcagccgctccacggtctcgctgaccttttcctcgtacaggttgatccgtgccgccgaggcggtctgcgcctcctgccactgcgcctgctcgaagcgcgcccgggcaccgtcggtgatctggcgaaaatgctcgcggtaatcgtcgaagccatcgaggatcgttcgagcgatatcggcggcgggccatttctgcggcatggtgagacctctgcgggaattcggaaaggcctgagcttagccagtgaaccgggtacaggagaagtgcaattttgcgcagatagcgaaggcggccgcccattcaaccgcaagatagcgattgcccgcgccctatctctcggcaacactctcgccctgctgaaaaaagggccgttgaacggcctattaaaggagttgcgctgtgagacttgtcgataccctgcgtttgttgtccctggccgcgatctggggcgcgagttttctgttcatgcgcatcatcgctccagtgatcggtagcattcccacggccttctttcgtgtctccatcgccgccaccggcctgttggtgatccttgcgttgatgcgcatcagttgggacttccagggcaagttcaagaccgtgctgctgcttggcgtaatcaactccggcatccccgccactatgtattcggtggcggccctggtgctgccggccggttattcggcgatcttcaatgccaccacgccgttgatgggcgtgctgatcggcgggttgttcttccatgaaaaactgaccccgccaaaaatcgccggggtcagcctgggcctgttcggcgtgggcatcctgacccgtgccggccccatggcattcgacctggaactgctgctgggcgcgctggcctgcctgctcgccaccacctgctacggcttcgccggcttcctcgcgcggcgctggctggaccaggccggcggcctcgacagtcgcctctcggccctgggcagcatgctcggcgccagcctgttcctgctaccgatcttcgcctacagcgccatcaaccagccgcccgccagctggggcggctggagcgtctggctgtcgttgctgggcctgggcctggcctgcaccgcctttgcctacatcctgtatttccgcctgctgagctcgatcggcccggtcaaatccatgaccgtgaccttcatgatcccgccgttcggggtgctgtggggcgcgttgctgctggacgagccgctgtccatggctcacctgtatggcggcgtgctgatcgccgcggccttgtggctggtcctcaagccaggggcccgggtcgcctcgccccgggaactggcggatcgttgatcgcgtcgattccccggcattgcgagcggtcctgaaacatgggcgcgctcgccacttgcatgacagtctcgatcaggcttgagcggaatcgaaccgcatatcggacaccgtaacttccgcccctcggcaaaagaacttaaaacaataaaaaatcatcaccttctaaaaacagatactgatctctcaacagaaacatcccttcaagcaaaaaaatcattaccccgccgtctttatttttcacccccttctttaccccccctcgtccaaactccataaaacttgaacacaattcgcaaaagaagtccgtgccagacagttccaccgattacaacaacgaactaaccacaaccaacaaagattattctcgatcaccataaagatatttctgaaaagtttaaaaaaagttcccaacctctctccctacgtatattcccgccttcttctttattaagttaccggcccattcacaacttccccggacaacttgatcagttattcaacgcttatgaacagatcactcaggccgcactgttacagcaccggtcctattgcacttcatagccagaaaactcctctcccggccaggaagcgcctcgcgcctctgtgcagccatcgaacgctttcaacccccggcgcgcgccgctgatccatagcgcactcaacgccatttccacccctccgaccacacaggcaccgccttggaaaagaaaaccatgacaccccacagcttcagaccctccagcaccgcgctcgccgtcgcactggcattgagctccttcgccccggccgtattcgccacgacgaactggaccggagacgcccatcattttgtctatgacgaggacggcaacgcctatcgtgtcgacgacggcaacgcctgggaagacaacggcaactggagcaacggcgctcccgccagcaatggggcggtcaacatcgaccggccgctcgccgggcgcaacaaccaggtcgcacagttggacagtgtacgaacggtcggcagcctgaacgtcggcaccgccaacaatggcctgggccagttgaatgtcggcgccaacggcaagctgaacatcggtgatagcttcaccctgggcaccgtccagggctccacgggcaaggccaccttcaacaacggcgcggcagtgaacagcggcggcgacctgatcgtcggcaaaggcggatcggccgacctgaccctcaaaaacggctccaatgcccgctcccagggcgacaccctgatcggcgcagaccgcggtgcctccggcacccttatcgtcgacagcggctcgacgctgaccagcgacaagcggctggtagtcggcggcgccggcaatggcaccctgcaggtcaagaacggtggccaggtcaccagccaggacagcatcatcgccgccgacctgggttccaatggcagcgccagcctcgatggcaccgacagcctgtggaagaccctcggcgacatgaccgtcagccagtccggcaacggctcgctgctgctcaccaacggggccaaggtgcagaccgctggcaataccgtcctcggtgcgctcagaggcggtagcggtacggtcagcgtcgacaacggcacgctgtccaccgacaagaccctgatcgtcggcggtgccggcaacggcaccctggaaatcaagaacggcggccaggtcaccagccaggacagcatcatcgccgccgacctgggctccaatggcagcgccagcctcgatggcgccggcagcctgtggaagaccctcggcgacatgatcgtcggccagtccggcaatggctcgctgtcgctcaccaacggggccaaggtgcagaccgctggcaataccgtcctcggtgcgctcagaggcggtagcggtacggtcagcgtcgataacggcacgctctccactgacaagacactgatcgtcggcggtgctggcaacggcaccttggaaatcaagaacggcggccaggtcaccagccaggacagcatcatcgccgccgacctgggctccaatggcagcgccagcctcgatggcaccgacagcctgtggaagaccctcggcgacatgaccgtcggccagtccggcaacggctcgctgctactcaccaatggcgccaaggtgcagaccgctggcaacaccgtcctcggtgcacacaaaggctcaagcggtacgctcagtgtcgacaacagcacactgtccaccgacaagacgctgctggttggcggcgccggcaacggcaccgtggaaatcaagaacggcggccaggtcaccagccaggacggcatcatcggtgccaaccagggtaccaatggcaacgccagcatcgacggcgcgggcagcctctgggaaaccctcggcgacctgaccgtgggccagggcggtaatgccagcctggtgctcgccaaccagagcgtggccaaagtcggcagcggcatcctgcggatcgccgccgacggcacctccaatgccgctctttatgtgggagcgaccagcgacaaggccgccgacgccaagggcgcgggcagcctggaagccaagcgcgtggtcttcggccagggccagggcctggtccagttcaaccacaacgaccaaaactaccagttcgatgccggcttcgaaggtcagggccgcatcaatcacatcgccgggcagaccgtgttcaacggtgactccagccacttcaccggccagttgaatgtcaaaggcggcgaactgctgctgaacaacgtcatggccgggcaagtacaggtcgacaagaacgccagcctgcacatcggtgccttcaacggcagccaaggcgaagtgctcagcgatatcggcaacgatggccaggtggtgttcgatcgcaacaaccagtaccagtacgaccacgtcatctacggcagcggctcggtcgagcagcgcggcacgggcagcaccgtgctcaccggcgaaaacacctaccagggcggcacgctgatcagcaacggcaccctgcaactgggtgccggcgcgaacggcggcaacagcggctcgattcttggcgacgtgcagatcgacgcgcccggcagcctggtgttcaaccgtgccaacggctacaccttcggcggcgccctctccggcaccggtacgctctataagcgcggcgccgggcgcaccgaactgagcggcgacagttccgtcttccacggccgcagcctcgtcgagtcgggcatcctcgccgtcaacggcaagctcggcggctcgaccgacgtgtatgacggcgcaaccctggccggcaacggccaggtcggcaacgtcaccctgcacaaaggcgcgaccatcgcccccggcaactccatcggcaccctgaccctgaccggcgacctcgaccagcacagcggttcgaccttccacgccgaactgctgagcaccggagccaacgaccggctgctggtgaacggcgcggcgcggctcgaggacggcagcatcatcaaggcggacaaactcgacagcaaacgctacgagctggaccgtcgctacctggtgctggcgacccaggaaggcctgagcggtcgctacaagctgacgggcgatacctgggtctcgaccttctatgacctggtggacaactacgacagccacaacgcctatctggatgtgcaacagacgcgcctgttccaggaagccgccttcacccccaaccagcgtgccacggccaccgcggcacaaagcctgaaaggcgcggccgtgccggcgctgactccaccgctgcacaacaagctgttcgaggccatcgcctatctgcccgacgaccaccaggctcgcgatgccttcgaccaactgtccggcgagttccacaactccacccgttcggcgctagtccaggacagccgcctggttcgcgacgcggcgaacacccgcctgcgctcggcggctgccgcccaggcccgtgacaccgcgagcgacactcactccggcctgaccccgtggatcaccacgctgggcaactggggcgaagtcaagggcgacagcaataccgccaacctgcgcagcgacaccaagggtttcctgactggtgtcgataccgcggtcggtgacagcggccatgtcggcgtgctgaccggctacagccgcaccgaactgaagagttcgtcacgcgactcctcgagcgacaacgacaacatccacctgggtgtctatggcggaacacaggtcagcggcttcgacctgcgcggcggcatggcgtacacctggagccggatcgacgccaagcgttcggtgaacttcgccggctacagcgaccacctgaagtccaagcatgacgccaacaccctgcaagccttcggcgaactgggccggcgcttcgacctcagcccttcggtacagctggaacccttcgccaacctggcctatgtgcaggtcaagagcgaaggcttcaaggaaagtggcggccctgcggccctgcgcgccaagcacgcgtcggacgagcagaccttctccaccctgggtctgcgcgccagcgccgacaagcaactggacaacggcaagttgctcaccgtgttcggcagcgccggctggaaacacgccctgaacggcatcacaccgtccaacacctaccgtttcgacggcagcgatgcgttccgtatcgaaggtgcggcctactcgcgcaacagcgcggtggtcgaagccggagtggaaacccgggtgactcccgagctgagcctgggcgccgcctacaacgggcaactgggcagcggcgccagcgaacatggcctgagcctgaacgccagctaccgcttctgaccccgccctgaccacgcagcggcggccccgccgctgcgtgttgtggattgaccggcaaggtacacttgccggtcttttttttgcctttcgtcaaggcatgcctccagcaacaacggggggcatccgtgacggtcattcaatacccggcgctctagcgccgggcattggcctatacctgacttatggcgacgtcaaggtaatcaggtacatccccgagttgaccgatttgcccgcctcgtcgaccaacgcatattgctgatcgtagtagcgcccttccttgccgctgtccgtgaccagcttgacgttgaccggcgatttgccgatggccgtcaccgagctcgataggccgacgccgtgtacacgaatgtcgttaccgcgggaaaactgcgggcactggcgaagattcaacgccgccccgccttgggcagtcgagcttggcgtgcaaggctcctcgacgatgctgccgtgaaaatagatcgttccctgaatgctttgaggggctgcgaaacagattccactcaagcctagaaacatgccgacacctgccaaaaccagcttggtactcattctgactttctccattgggcctgaagagtatgtcgtcagtgtagaagaaatctttaacttttaaggtttgtcttattcccaagcaatcaataaatagggtaaaagcgaatgcaaattaatggcaatgagccatcattgttatcgaccggccctggccaatctgaagggtgcgcccaggcaaaaaaaggcgcagccttcgctcaagtcgaaagctgcgcccggccctcatgaatcagctgtttttgcggaacacgaacaccaacccgacgatgatcaacagcatgccgagcacgctcagcagtgccagccgattaccgaagaacaggtagtccatcacggccgtcaccgccggtaccaggtagaacaggctggtgacattcaccagattgccgcgagcgatcagccggtacagcagcaaggtcgccagcaccgagaccaccagccccatccacagcgccgggacgataaagccgacgctgtgctcgaagtgaaacggctggaacggcacgaacagcgcgcacagcaacagccctgccaggtactgcaccggcagggtgcccagcgggttgtcgctgatgcgcttctgcatgatcgagcccagggtcatgctcaccagggccagcaggccgaagagcatcccggccagcgacatgccggccagaccgatgccctgatacaccaccatgatcaacccggccaaacccagcgccaggccgaacatccggctccaggagcgctgacgctccatgatcaccacggtgaggatgggttgtactcccatgatggtggccatcactccgggggtgaccttcaggtccagggccagcaggtagaagatctggtatgcccccagcaacaccagcccggtggccaccgcgtacagcatcggcttgcgcccgcggggcaaacgcagcttgagcagaggaatcaacagcaccagcccgcacagggcgatggcaaaacggaacaacaggaaggcaaagggcgaggcatgggccagcccccatttggagaagatcgccccactgctccagagcaggacgaacaggctcgtggaagccgccgcaagcgcggactttttcgatatgaacaacatgaataccacctgtaatcaggcaaatagccaacccagccgaggctgaaattcagtagttttttctggcgggcgcgggcaacagcagaggttgccgatcagccccgtacgacgacgcccggcggcgatacgacggcgcgcaccggcgtgctactgacaggtggggggtaatgactgatctgcacaggctgcgggttcccgcacggcaggacgccagcgttgaccgctgaatcgactaccgcgttgatgagggaatgaggcatgtgctgatctttctgaagtggaaggtgaatcttctgatacaccgggcgccgactataaccagcgcccgatattcattgcaacgccttatccgaacagccagtaacccagggcggtcaggaccaccaccgccagcaccggacgcatgacgcggtagagcttcggattgcggcgcttccattgcttgaccacaccactgatgcggtcgctgaaacgtttgctccaggcataggcctggttgatcccgccgacgcgctcgtcgtcgaggttctgcggcgcggtggcacgccccagccaggcgctgatccagcggttgatgcgggtcatcagcgggttgctcagcggacgctcgatgtcgcagaacagaatgacccgggtcttgtcggtctcgttttttacccagtgcacataggtttcatcgaacatcacgtcttcgccatcgcgccaggcgtagacctggccgtcgacgaaaatccggcagtcgtcggagttcggcgtggacaggcccaggtgataacgcagggaaccggcgaacggatcgcggtgcgggttcagatggctgccaccgggcagcagggcgaacatcgcgcccttgacgttgggaatgcggctgaccagttcaacggtcttcgggcacagcaactcggccgacggcagcggtttgtcgtaccacttgaggtagaaacgcttccagcccttcttgaagaacgaaccgaaaccggcgtcgttattcttctcggcggcgcggatgtaaccctcgtcgaacaaatgcatggcttcgtcgcggatcacttcccagttgtccttgagcacatccagctcggggaacttgctgcggtccaggtagggcttggaaggcacaccggaaaacaggtacatcaaggcgttataaggagcgaacagcgccgaatggttgacgaactggcgcagcaccggcagtcgagccttgccgcgtaaatgcacgtagagagtgctgccgatgaatagcagcaacaccgcggacttggcggcaaacgaaaggctcatgcaatatctccttgaaataatcaccggcggggcagcattcatccggcatggcagccggccatgataaacactcctggcccctggaaaaacccgcacaaaccgacaatcagtgttaacagttgtgcaataaaacgctgattaacacacgacagctgaacgccagctgatgcaggtcagtacacatgtgacatgccctgtacgccgcaaccgccgtaccttcgatcgccggcaagcgggcttctgcggagcctgccggcgatcaccttcccactgccttactgctggttctcctgctcggtgaacaggtcgctgaacagcatgctcgacagataacgttcacccgaatccggcagcaccaccactatggtcttgccttgcatctcgggggtttccgccaggcgcaccgccaccgccatcgccgcgccgcaggagatgccacagaggatcccctcctcctgcatcaggcgcagggccatggccttggattcctcgtcgctcgccagctcgacccggtcgaccatcgacaggtcgagattgctcggcacaaaaccggcaccgatgccctggatcttgtgcgggctgggcttgatctcttcgccggccagcttctgggtgatcaccggcgagacgctcggctccaccgccaccgacaggataggtttgccctgggtcttcttgatgtaacgggaaaccccggtgatggtgccgccggtgccgacgcccgctaccagcacgtccaccgcgccatcggtgtcattccagatttccggaccggtggttttctcgtggatcgccgggttggccgggttatcgaactgctgcggcatgaagtatttgtcagggtcgctggcgaggatttgcgcggccttctcgatcgcccctttcatgcccttggccggctcggtcagcaccagttcggcccccagggccttgagcaccttgcgtcgctcgatgctcatcgacgccggcatggtcaggaccaacttatagccacgggccgcggcgacgaacgccaggccgatgccagtgttacccgaggtcggctcgatgatggtcatgcccggcttgagtttgccgctgctttccgcgtcccagatcatgttcgcgccgatccggcacttcaccgaataacccgggttgcgcccctcgatcttggccaggatggtgacgccgcggggtgcgatgcggttgatctgcaccagcggcgtattgccgatggaatgggcgttgtcaacgaaaatgcggctcatggctgggtccttgtacagcgtgaaaggaagtcttcaagggtatgcctcgcacccatgagcgtccagtcgggacgaacgactgcgatgccggggagtcaatcgctataaggcacatggctggagactcatgctcatgaaacgtcgctacagttggcccctgtggaccctcgccggggtgctggtgctgctggttgccctgcacatcgccctgccctatctggtgcgtgattacctcaatgaccgcctcgccaacatgggcgactaccgcggccagatcgccgatgtcgacctggccctgtggcgcggtgcctaccggatcaacggcctgaaaatcgtcaaggtcgacggcaaggtgccggtgccgttcgtcaatgcaccgctggtcgatctgtcagtgagctggcactccctgtggtacgaccatgcggtggtggccgaagtgcaattcgtcgggccgcaggtcaacttcgtcgacggcgccaccaaaaagaactcgcaaaccggtgaaggcaccgactggcgggcccagctgaacaaactgctgcccatcaccctcaacgaagtacaggtcagcgacggcaagatcagtttccgtaacttcaactccaaaccgccggtgaacatgagcgctacccaggtcaacgccagcgcctacaacctgaccaacgtggtcgacacccaaggcaaacgcgacgcccgcctcgaaggcaaggccctgctgctgggccatgcgcccctggaaaccaacgccaccttcgacccgctgagcgacttccaggacttcgagttccgcctgcgcgtgcgggatatcgaactcaagcgcttgaacgacttcgccggcgcctatggcaaattcgacttcaacgccggccacggcgacctggtgatcgaagccgaagccaacaagggccagctcaccggctatatcaagccgctgctgcgcgatgtcgatgtgttcaattggcagcaggatgtcgagaacaaggacaaagggatattccgctcgatctgggaagccctggtcggggtcagcgaaaccgtgctgaaaaaccaggggaaaaaccagttcgccacccgggtcgaactcaaaggcagcgtacatcagcgtgatgtcagcgcattccaggcttttttgcagattttacgcaatggtttcatcgaggccttcaatgcccagtatgagcgttccaagccatccactgactgagtcaccaggtgacgccccattcagagactgaatggggcgtctgcgttcacagtcgaccgggcgccgcgttatagtcggccattcgtgttttattcttccgacctgctcgatgcacgtcggcgttaccgttcgaggaattgcagatgaagttcgaaggcaccagcgcgtacgtcgccaccgatgacctgaagctggcagtcaatgccgccatcaccctggagcggccgctgctggtcaagggcgaaccgggcaccggcaagaccatgctcgccgagcaactggccgagtccttcggtgccaggctgatcacctggcacatcaagtccaccaccaaggctcaccagggcctgtacgagtacgacgcggtgagccgcctgcgcgattcgcagctgggcgtggacaaggtgcatgacatccgcaactacctgaagaagggcaagctgtgggaggccttcgaatccgaggagcgggtgatcctgctgatcgacgagatcgacaaggccgacatcgagttccccaacgacctgttgcaggaactcgacaagatggagttctacgtctacgaaatcgacgagaccatcaaggccaagcagcgcccgatcatcatcattacctccaacaacgagaaagagctgccggacgctttcctgcgccgctgcttcttccactacatcgccttccccgaccgcaccaccctgcagaaaatcgtcgacgtgcactacccggacatcaagaaagacctggtcagcgaagcgctggacgtgttcttcgacgtgcgcaaagtgccgggcctgaagaagaagccttcgacctccgagctggtggactggctcaagctgctgatggccgacaacatcggcgaagcggtgctgcgcgaacgcgatccgaccaaggccatcccgccgctggccggtgccctggtgaagaacgagcaggatgtacaactgctcgaacgcctggcattcatgagccgtcgcggcagtcgttaagaggctgatgccatgttgctcaacctgttcaatgaaatgcgtgccgccaaggttccggtgtcggtgcgcgagctgctcgacctgatcaacgcgctcaagcagcgcgtgaccttcgccgacatggacgagttctattacctgtcccgggcgatcctggtgaaggacgaacggcacttcgacaagttcgaccgcgcgttcggcgcctacttcaacggcctggaaaaactcgacgaccacctgcaggcactgatccccgaggattggctgcgcaaggagttcgagcgctcgctgaccgatgaggaacgggcgcagatccagtccctcggcggcctggacaagctgatcgaagagttcaagaagcgcctggaagaacagaaggaacgccatgccggtggcaacaagtggatcggcaccggcggcaccagccccttcggctccggcggtttcaacccggaaggcatccgcgtcggcgacgccggcaagcgccagggcaaggcggtcaaggtctgggaccagcgcgagtacaagaacctcgacgactcggtggaactgggcacgcgcaacatcaaggtggccctgcgccgcctgcgcaagttcgcccgccagggcgcggcggacgagctggacatcgatggcaccatcgattacaccgcccgcgatgccggcctgctgaacatccagatgcgcccggaacgacgcaacagcatcaagctgctgttgctgttcgatatcggcggctccatggatgcccacgtgaagatttgcgaggagctgttctcggcctgcaagaccgagttcaagcacctggagtactactacttccacaacttcatctatgaatcggtgtggaagaacaacctgcgccgcggctcggaacgcacctcgacccaggacgtgctgcacaagtacggcgccgactacaaagtgatcttcgtcggcgacgccgccatggcgccctacgaaatcacccaggccggcggcagcgtcgagcactggaacgaagaagccggttatgtgtggatgcagcgcttcatggagaagtacaagaagctcatctggatcaacccctacccgaaagacacctggggctacaccgcctcgaccaacatcgtgcgcgagctgatcgaagaccagatgtacccgctgaccttgcgcggcctggaagaagggatgcggtttctctccaaataggatcccgtccaacgcgatccctgtagccgctgccgcaggctgcgataaggcccgaagggccttcaagcggactcaagagcgcgtctgcttcgcagccgatcgcagcctgcggcagcggctacatcggttcagacaaaccgccgcaaaaactcgatctgctgccgatacgccgtctcctgcaccaccggcgtcaggcgcacttcgctgcccggcaggcattgcgccagccgcgccagcgccaggggcgtcaaggcccccagccgtggatacccgccaatggtctgccggtcgttgagcagcacgatcggctggccgtccggtggcacctggatcgcccccaggggaataccctcggagatcatcggcgccccttgataacgcagtgacggccccagcaggcgcattcccatgcggtcggcgcggctgtccagggtccaggcgctgttgaaggcatcgaacagactctgcccgctgaactggccgttctgcgccccgagaatcacctccagcggcgccttcgattgcaggtccggcagttgcttgcccgacagcgccttgaggttcgtccctgccccgcaatactccagccgcgcgcccgcggccagtggccggccgaagccgtcgagtccgcccagttcctcgcggaccacgctggcgcaactgcccagcaccttaggcgcattgaaaccgccgggcgccgccaggtaggcccgcgccccctggtacggctgggtgaaacgcaaccgctggcctttttgcaggataaagctgcgccccgggctgagcggacgctcgtcgatacaagcccccaggtcggcgcccgccagtgccagcaggcacaactcctcggcgaccacgctgaaaccgcccagggtgatctcgatcaccggcgcatccagggcgttgcccagcagccagttggcccaggacatcgacacccagtccagcgcgccgccctgggtcacgcccaggtgccgcacgccaaagcgaccggcatcttgcaacaggcacaagggcgtactggcttcgatcgtcaggcggctcatgccagtgcctccagcagtggcgtgtcgtcaccgcccaggcggatgaattcggcgtggtccaccgcggcgaaacgcacgctgtcgcccggttgcatcaggctgtagccatcgcgctcgcgatcgaacaggcggctcggtgtgcgcccgatcaggttccagccccccggcgacaccaccggataagccgcggtctgccgttcggcaatgccgacgctgcccgccgccacgcgcttgcgcggggtatccaggcgcggcgcggccagcacttcgtccaccagccccataaaggcgaaccccggggcgaaacccagggcgaacacctggtattcacgctcgctgtggcaacggatcacctcgttcaccgacaggccgctgcgccgcgacaacaggctcagctccgggccgacgctgaggtcgtaccagaccggcagcacatggcgctggccgccggtgcgcgagtccggcgtgagatcggtcagggccagatcgatcagttcccgcgcctgggacgggctcagggcagtcaggtcatagtgcaccatcagcgtggtataggacggcaccagatcgatcaactgcccgccgaaggccgcccgcaggcgctcgctggcagcgagcatccacggcatgttggcctcggcgatggcatcgaacaggcgcaccatcaggcagtcgatggccaccacttcaaggcgtattttcatgctggcaactgcgcaagggccgcgcggatacgctgcacggcggccaccgaactggcgttgtcgccgtgcacacacagggtattggccttgaggtgcaaggcgctgccgtcgctggccagcagcgcgtcgccgcgggcgatggtcagggcctgggcgatgatcttttccgggtcgtgatgcaccgcccccggcagttgccgcgaaaccaggtgaccggcgttgtcataggcacgatcggcgaaggcttcgaaccacagggtcacgccgaattcgtcacccagggcctgggccgcgccgttgtcacgggtggccatcaacatcagcggcagcgtcttgtcgtaggcggcaaccgcctggatcaccgcgcgcagctgcgccgggttggccatcatgtcgttgtacatggcgccatggggtttgacgtagctcacccgagtgccctgggcccggcagatgccgtcgagggcaccgatctggtagtgcagcaggtcctgcagttcctgggcgccgtaggccatggagcggcggccgaaaccggccaggtcctggtacgccggatgtgcaccgatgcgcacgccattggccagggccaggctgacggtcttgcgcatgatgctcgggtcgccggcatggaaaccgcaggcgatgttggcgcaatcgataaacggcatcacctcggcatccaggcccatggtccagttgccaaagctttcgccgatgtcgcaattcaataacaggcggctcacggtcagtgctcctgtagcgtttgtcatgttggctgcggggatcgcgcgggatgcccacagattatcagttagcgcgcttcgagttgtttgccacgggtttccggcaggctcagggccgccaggaccacgatgccgtaggacacagcggcgaaggtaccgatggccgcgcccagcgggatgtgctggctgagcagcccgatcagcagcgggaacagggccgccagcgcccggccgctgttgtagcagaagccctggcccgaaccgcggatccgcgtggggaacagctccgtcaggaaggcgcccatgccgctgaagatccccgaagcgaagaagcccaggggaaagcccagccatagcatcaccgcgttgctcaccggcatttgcgtgtacagcaggacgatggtgaaggaaccggcggcgaacaggacgaagttcttcttgcgcccgagaatatcggtcagataagcactgatcacataacccacataggagccgaagatcaccatcgccaggtagccgccggtgctcagcacgctcaagccgcgctcggtcttgaggaaggttggcagccagaacgtgatggcgtagtagccgccctgggcgccggccgcgagcagcgacgcgcgcagggtggtgctgagaatgccgggggcgaaaatctcgtagaagcgcgaggggttgtcgggtacttcccgggcccgggtttgccggtagacctccgggtccttgaccaggcgacggacaaaaatcacgaagatcgccggcaggatgcccagcaggaacaaggcgcgccaggcgtcttccggtggcagcagggagtacatcaacgcatagagcagcgccgtgatgccccagcccagggcccagccggactgcaccatgcccactgccttgccgcggttttccgcgcggatcacttcgccgatcagcaccgcgccggcggtccactcgccaccgaaaccgaagcccatcagggtccgggcgatcagcagttgctcgtagttctgcgccaggccacagaggaaggtgaagacggcgaaccagagtacggtcagttgcagggtgcgcacccggccgatgcgatcggacaggatgccggcgatccagccgcccagggcggaagccagcaaggtgctggtgtggatcaggccggcctcggcggagctgatgccccacagcgcaatcagggtcgggatgacgaagctgagcatctgggtgtccatgccatccaggccgtaaccggccttgcagctccagaacgtgcggcgttcctgctggttgatgtcgcggtaccagtcgaaggggccggcgcggcctttggccttgctggcggcgagcgtgtcgggcgcactcatggcaaatctccaccttggttttattggtattgttctgggccccgacgacgcttatcgtgagacgcagcgatttttggcgcccgcgccctgccccgtccaactaataaaaaccgcctccagacataagaaaagttgatcgcatgaacctcaagtttcttgaaacctttgtctgggtggcgcgcctgaaaagctttcgcctgaccgccgacaaactcttcaccacccaggcgtcgatctccagccgcatcgccgtgctcgagggcgaattgggggtgaagctgttcctgcgcgactcgcgcggcgtgagcctgaccccggaaggcctcaaggtgctcgactatgccgagcagatgatggacaccatgcaggcgctcaagcagtcgatcgagacccgttcgagcaaggtcgggcggattcgcatcggcgtcatggacacggtgatccacacctggctcagccccctggtggcgcggatgatggacagctatccccaggtggaaatcgagctggtggccgacacctcgctgaacctctgcgatcagctgcaaaaaggctttctcgacctggtcctgcaaaccgacctgctgcgccaggaatccattcgcagcctggaactggccagccaccccatgggctggatagtcgccagccactcgatctacaaccgcgagtacgccaacctggccgagctggcccgggaacgcatcatcacctactcgaagaactctctgccgcaccaggaagtgctgagcctgatgcaggccaacggggtggccgcgccacggctcaactgcgtgaactcggtgtcggccattacccgcctgctgcgcgacggtttcggcatcggcgccttgccgccggtgctggtcagcgaggaactggcgcgcggcgaactgaccctgctggccatcgaccagcgcccgccgaacctgcaggtagtggtgtcatggcgggtgggggtcgaactggtggaagaggtggtggtgctgtgccagcaagtgctggaaagttatgcgcgcaaggtgggaccggactatatcgtgctggcgggctgacctgccgcgaaggcctttgtagccgctgccgaaggctgctatcgcgggcgcagcctgcgtgaatcggctcgatgagcgtttgtcagccagccatctttgcggttgctgcgcaaccgatcgcagcctgcggcagcggctacagggatcgcggcgtccgtgtagccgctgccgagcctgcgaggctgcgaacggcaacgcagttgccgcacaacctgcatccgcgatctgcctggaaaaacgcgtcggctggtttacgacggctgcgccgtcgatcgcagcctgcggcagcggctatatcacaagcccttcaagtcacgctcttcgatcggccggctctggcgcaggcgcttgccgccgagtaccacccagtcgatcaggcgatacaggcattccaggccgaacgacagcagcaaggcaccgctcatggcccagatcatcgcttgcggggtcagcaggatctggtagctgtagccgttccaggtttcctggcggatatccgggtcggcggccagcaccacttgcagcaggcggatgtaccacgggccctgcatggcctggaactgcttgtccagggcgcgctggcgaaccagcagattgcccaggctgtcggcgtcgctgcgaaacaccggatcgtcgctggcccgatagtgggcgaccagcgcctgcagatcgcccttgaagaactggttggcggtgccctggaacccttgcaggccggcctgggcctcgatcaggtgagcctcgacacgcttggcgtaatcgctgatgaaacccggcacctgtacgccgatcaacaggcccgccgcaaacagcaccagccgcagataactgagcaacataggggatgtccttattcggtctggccgtgcagcacgcattcaccgcgccgccacaggctccattggcccggctcgtagcgagtccaggtttcgttttcggtcaaaggttcggtggcgatcaccgtcaccacgtcgttgggcgtggtttccgcctggaagtcgacgatcacatcgacgtccttcaggcgggccgggccaaagggagcgcggcgggtgatctgcgccagcttggtcgagcaatagcagaacagccagtcgccgtcgctgagcaggcagttgaacacgcccttgccgcgatattcggcgcaggcggccaccagcgacggcagcagttcctcgacttccactggctcgggaaaggcttcgcgcacccggttgagcaggtcgcagaaagccgcttcgctgtcggtatcgcccaccggacgatagaagctggtggggggctggaagtccgccagctggccgttatgggcgaaacaccagttgcgcccccacagctcgcgcacgaacggatgggtgttggacaggcagaccttgccgacgttggcctggcgaatgtggccgatcaccacttcgctcttgatcgggtagcgctgaaccagattggccacttccgactcgctgctcgccgccgggtcctggaacaggcgcaggccgcggccctcgtagaaagcgatgccccagccgtcgcgatgcgggccggtgcgtccgccgcgctgcatcagcccggtaaagctgaacacgatatcggtcggtacattggcgctcatgcccaataactcacacatgctcggactctcgcttcaatgcgtgttacagacgcggctcgatccgcgaacgctgggggttgctgggcactggcgggcggccgtagcgatcgtcgccggcgccgccgaaaggctggtcgtccggctcttcggcacgggccgcggccttggcggcttcggcctgttcctggcgggccttggaggcgcgctcgatcggccagcggatcaggacgaacaccaggtagatgccgaaggcgatcacgccgtacatgaacaggtcggagaccgcgcgccaggcgttgttgccgaccttgaacagcatgtccagggcggtgatggccacggccggggcgaacatttccttggccgggtcgaccacggtcgggctgaacagcagcaccgccaccagcactcgcagcggctcgcgcagccagcgccacatccagcgggtcaggcgcatccacaccagcaggcagcccaaggcggcgaaggcgtagagcccccaagcgatcagatagtcgttctcggtcatggtgtccatggcaaggcaggcaaagaggcgcttatgataacggcttttcgcatgccaggctgcaccgctgtctgcagcgcccttaattgtcactgccccgagagcccttcatgcccgtatccgcccacgtcaccagcgccccgatcgcccgcaaggccgaaggtccggacccttacgcctggctccaggaacgcgacaccgatgccgtgctcgattacctgaaggccgaaaacagctaccaggaagccgccctcgccgaccaggcggcgctgcgtgaaaccctgttccaggaaatcaagggccggatcctcgagaccgacctgtccctgccctccccctggggcccgtacctgtattacacccgcaccaccgccggcgacgaatacgcccggcactaccgctgcccgcgctcggccgacgacagcctgagtgtcgacgaaagccaggaacaactgctgctggaccccaacgagctggccaagggtggtttcttctccctcggtgccttcagcatcagccccgaccaccagcgcctggcctacagcctcgataccagcggcgaagaggtctacaccctgttcgtcaaggagctgtccagcggcaaggtcagcgaactggcgttcgccgattgcgacggcagcatgacctgggccaatgacagcctgaccctgttcttcggcgagctggacgatacccaccgcccgcacaagttgttccgctatcgcctggacggcaccgccgccgaagaggtgttccatgagccggacgggcgctttttcctgcattgctaccgctcaagctcggagaaacagctgctgctgtccctgggcagcaagaccaccagcgaggtctgggtactcgacgcggcgcagccgcagcaggccttcacctgcctggcgccgcgggtcgagcaccatgaatacgacgtcgatcacggcctgctcgatggccagtggacctggtttatccgcagcaaccgcgacggcatcaacttcgccctctaccaggcgccggacctggacacggtgccaggccaggccgactggcagaacctgatcccccacagcaatagcgtgatgctcgaaggcctgagcctgaacagctcggccatgaccctgagcctgcgcgaaggcggcctgccgatcatcgaggtgcatcccgagggcctgccggcctatcgcgtgcaactgccggatgcggcctacagcctgcatgtgcagaacagcctggaattcgtcagccaacgcatccgcttgcgctacgaagcgctgaaccgccccgcgcagatccgccagctggatctggccggcggcgaacagaaagtgctcaaggagaccccggtgctgggcgtgttcgacccggatgcctatgtcagccagcgcctgtgggcgaccgcggccgacggcacccaggtgccgatcagcctggtgatcaaacgcgaagccctgggccggccggctccgctgtacctctacggctacggcgcctacggcgaaagcctcgacccgtggttctcccatgcgcgcctgagcctgctggagcgcggcgtggcctttgccattgcccacgtgcgtggcggcggcgagctgggcgaagcctggtaccgcgccggcaagcaggaacacaagcagaacaccttcagcgacttcatcgcctgcgccgaacacctgatcgcccagggcctgaccacttccgagcaactggccatcagcggcggcagcgccggcggactgttgatcggcgcggtgctcaaccagcgcccggaactgttcaaggcggcgatcgccgaggtgccgttcgtcgatgtgctcaacaccatgctcgaccccgagctgccgctgaccgtcaccgagtacgacgaatggggcaacccggaggaacccgaggtctacgcgcggatcaaggcctacgcgccgtatgagaatgtcgaagccaaggcctatccggcgaccctggtgatcgccggctacaacgacagccgcgtgcagtactgggaggcggccaagtgggtggcccggttgcgcgccaccaagaccgacgaccacctgctgctgctcaagaccgagctcggcgccggccacggcggcatgagcgggcgttaccagggattgcgtgacgtagcgctcgaatatgcatttgttttcaagattctgggcattgcctgaggaactccggccggcgctcctgtcttaacaccggagcgccggccccaggccatactgcacctgcccggaaccgcaacagacacaagaaaaagaccgtgacgacatgccagaacctaccttgttgaacaatgaaatccgcgactggctgatggactgcggattgttcgatcagctcttgccggccgacttcaatgccgccgccggttacttcagcatcagcagcatcgcccagggccaggagatcttccgcgaaggcgatgccggcagcttcatgtgcatcatccattccggccaggtggcggtgcagaagaccaacagcgaaggcgtgcgcgtgaccatcgccaccctgcgcagcggtcgggcctttggtgagatggcggtgctcgatggcgagcggcgttcggccagttgcgtggccgccagcgattgccggttgctcaacctgggcaaggactcgctggagaaaatgctcaacgacgcgccgaagatcgccgccaagatcatccgcgccctcgccgtgtcactgtcaaagcgcctgcgcatggccgacgggcaactgctgtcgcaacaggtctagctacccggggtcctggttttcgtttcgttctgctgcaaccctggcaaggtctggtccttcggcggcttgggcatgtcgatcggcggcagcaagggcgcaccgccatgggccgtggccttgggggtgctggggggcgtgacctgcggataaggggtcggggtcgcggtgccgggcgagccagcggcgggggccggagtcacgggcaccgcctgcagttcctcggcgtgcacggcgctcatcgcgagcgccgcacttagcaagagcgctgcgcgggcaatgaccgttagaatagtgcgcttcatcaatggctccatcgctattgtcagccctcaggctactcccaaccggggcggtttgccttcctcattgagaccctcatgaaacgtttcgttctgctggacaccaccccgattcccgaaaatggcggtgccttgtgcctgttcgaatacggcgaggattttgtcatcaagatccagggcggcgacggcgggcaattgatgaacacgcgcatgcacggctccgaagacgccctggcggaaattccctgccgcaaggtcgccggacggccgaattcgcgggtgctgatcggtggcctgggcatgggcttcaccctcgcctcggccctcaagcacctgggcaagaatgccgaagtggtggtcgccgaactggtgccgggggtggtcgaatggaaccgcgggccgctgggggagaaatccggccggccgttgctcgacccgcgcacggtgatccgcatggaagacgtggccaaggtgctgcaggccgaaccccagggcttcgacgcgatcatgctcgacgtcgacaacggccccgaaggcctgacccagaaggccaacagctggctgtactccgccgccgggctggcagcctgcgcccgggccctgcggcccaagggcgtgctggccgtgtggtcggccagcgccgacaagcagtattccgacaagctgcgcaaggccggtttcaaggccgaggaagtgcaagtcttcgcccacggcaacaagggcacccgccacaccatctggattgccgagaagctcaaggcctgagctaaactgggctcattaccgtcattagtctttgcataaaggtgaccccatgagttcgaccaacacttccaagctcgaccgcatcctcgccgacgcccagcgcgaccgcgagatgggctaccgcgacaaggccctgaagatgtacccgcacgtctgtggacgctgcgcccgcgagttctccggcaagcgcctgagcgagctgaccgtgcaccaccgcgaccacaaccacgacaacaacccacaggacggttccaactgggaactgctgtgcctgtactgccacgacaacgaacactcgcgctacaccgaccagcagtacttcggcgaaggctccctgagcacgccgaaagtcgccaaggccacccacaaccccttcgccgcgctggcggggttgatgaagaaagacgacgaataacgtcctcacggctgttttgtccgctcctttctttcgcgagcaagctcgctcctacagctcttgcgtacctctgtagaagcgagcttgcttgcgctggcgtcagccgggacgccgctacccacgagcctcacgcccctcgtccaatccccgtataatcgcgatttttctcgaaggcaccccgctcgtggcaaacaaaaggtacagctgcattggtttgtataaccccaagtcaccggagaacgtcggttcggtgatgcgcgccgccggttgctatggcgtcgcgtcggtgttctacaccggcaagcgctatgaacgggcccgcgacttcgtcaccgacaccaagaaggtccaccaggacatcccgctgatcggtatcgacgacctgaagaagatcctgcccctgggctgcgtgccggtggcggtggaactggtggaaggcgcccgctcgctgccggaatacactcacccggatcgcgcgctgtacatcttcggcccggaagacggctccctggacaaggacatccgcgactggtgcgaagacgtggtctacatcccgaccaccggctgcatgaaccttgccgccaccgtcaacgtggtgctctacgaccgcctggccaagggcaacaacacccgctccggccccaagttctgagcactgcttcaagttcgccgcacattcgatggaacaagcgacgcgccagcgcagtcagctttatatccatcccccctggagacagatcatgagcgacagcaaacaactggaacccatcgcaaccacccctttccagagcccggcggagcagaacgtacaaggctgggaacgcatcggctcgctggccggcggcgtggtcatggttggcaagggcctgcgccgtggcggtgtgttcggcctgatccaggtcgccatcggcggggtcgccctggcccgtggcatcaccggccacagctcggcgaaaagcctgctggagaagagccgccaggatatgaataacgtacgggcgaagatcgagcgtgccggcgcggagctgaaaaccctcaaggccaatgccgaggcggccacccgcaccgcgaccgtaaccggcaacgattcgttgaaatcgcccaaggccggggtttgatcggcggcctcgaacgccgcgttgaatgaaccggcgctatcgcgagcaagctcgctcctacagggggttgcgcaaaacctgtaggagcgagctcgctcgcgatgaccgcaaagcggtcgactccactagcgcaacaaatcgctgtcgagcaccttcgacgagccgtccagcacactctcgctgagctggatgaactctttggtgctgacacgctccagacgcatcaccgcccgggtcacgtcatccagcgaacgcttgttgcgggtcttcaggcggatctcccgatccagttcctgcaacagcagcaccgccctggccaccaccggcgcgtccacctgctcgccgcgcaagctgctgacgccgtggccgctcttggccaaccgagtctgcagggcctggtaacgctcgtcgctcatgccgccggcgcggcgcatcaattcgatggcgtagtactccgccaggccctcgccgatccagtcgctgcgctcgctgtcattgatccgggcaaagacctggatcacttcgcgcagcagcgggctggtgccgctctcgctgaccagcggcaggcggctatgcaagaacagcgaatcgtgcccggccaggctgccgcgccacatcgggtcggccgcgccgacgatcagaaacttggttggatgacggggaaaggtcgcctggatctgcggccagacgaaggtcagcagggtcagcacatccatgcgtcgcatgccctgcccttgcggcgaggccaccgtgacttcggtctcccccagccgcgtgcgacgactgcccagggcaccggccagcatccagccggtgggccggtcgaacaggcgcgcggggttatcgatacggaaacgactcttgccgatccgcggccaggcggtttccacgcttttccagcccgcgggcaattcgaactccaggcgcgacaccagttcgatgccgtcctgctggtcgagtttcgccgccggcaccagcgtatcgccacgcaacaaggcccaatgcggggtcatgcggctgtcgaagctgtctttcttcaggctgtggctgatgcgcacccggtagctcaggctggccttgccgccggccgggcgccatacgccgcgctgtaccgcgggaggcttggccgcgccggactgccattggccgtcggccttgaagtcgctgtagtcgccatgcgtgcccaggtcgaaatccaggctgcgcaccgccgcgccgtccgccagggtcaggcgcacctcggcctggtcgctctgcggcaacaggcgcacgtggtaatccagatcgacttttttcgccgcccaccccggcgcactgagcaccagcagccaaccggccagcgccagccttgcccccacagccatacacactccttcgtgaaacaaccttgaatgcgagcgcggcgtaccttcagccggcgcggaaaatcagatgatcttcccagtcttcctcggccacgctgccttcggcgagcatccgcccggattgggaaatacgctcgtggtgcaccgcgtcgcggtcaccgcacaccagatggtgccagagcggcaggtccttgccctcgctgaccaggcgataaccgcaggtcggcggcagccatttgaactcatcggccttgcccggggtgagctggatgcaatccggcaccgaggcgcggcggttggcgtagtcgctgcactggcaggtcttcaggtccagcagtttgcaggcgatgcgggtgtagtagacgctgttgtcttcttcatcctcgagcttctgcaggcagcacaggccacaaccgtcgcacaacgactcccactcctcctgatcgagttgttcgagggttttgcggatccagaagggttcaactttggcggccatggctcaggtaatcggtatcggacagggaaaaggccgccagtctagtgcccaaggccccgcgggccaagcgctggcgactgtcggtaaggcactacttgtcaggccgcatgccgcgcagtagctttgcctgtcgcaaagccctatgtccgcgtgccaaggagctgtacgaaaagtcggcgagcgaaggtcaggcaaggcaaaaacaggcgaggaacggtcggggtcgcgttcgactgtagggacctacatgagcattccgagcctgtttttaacgcagcatgacctgtgtagcgccgaaggcgcccagcgcgcagccacttttcgttcagctcctaacgctcgaccgcgtcgcaccggtgaatcgcccagggccaggaaaaaaccccattgcccagttcaactgcgcttgccggtttatccacctttcattctcaaacgtagccaggaatctctgtcatgagtgccaatccccgcgttgccgagtacgccatccatccgcagttcaccgagcgctggtcgccgcgcgccttcaccggcgaggctattcccgaggaaaccctgctgagcttcttcgaagccgcgcgctgggcgccgtcggcctacaactcgcagccgtggcgctttctttatgcgcgccgcgacacgccgaactgggaacgtttcctcggcctgctcaacgagttcaaccgtggctgggcgcagcacgcctcggccctggtgatcgtgatctcgaaaaccaccttcaccgcgcctggcgccagcgaggaaaccccagccctgtggcacaccttcgacaccggttcggcctggggccacctggcgctgcaagccagcatcagcggctggcacacccacggcatggccgggttcgaccaggagctgacccgcaaggagctgaagattccagaaagttatgccctgcatgccgccgtggccgtcggcaagctgggtgacaaggcgagcctcgccgaatacctgcaggcccgcgaagagccaagcccgcgtcgcccgctgagcgaaaccgcggccgaaggtgatttcagcctgtaagccagcaacctgtagccgctgccgcaggctgcgatcggctccgaaggagacgcgctcctgagggcctcggaaggtcctgcggaccttatcgcagcctgcggcagcggctacagagcccgcgatacttcttcagtaaccgcgggtgaaatccacttcgccacgcaacgccgtgtcggcctgataggcccgcaggttgtcgatgaacagctgcgccatcagggtcggcgaggtcggcgccgagctgtggccggtcagcagcaggccccaggcggtccagaacggatggcgctgcggcaacggttcctgacggcagacgtcgatcaccgcccccgccagatgcccttccttcaaggcttccaccagatccgcatcgaccaccgcgaccccgcgaccgacgttgatgaacaggccggtcggcttgaaacgcttgaacagcgccgcgtcgtacaggtcatgggtgtgcggggtgttgggcagcaggttgaccacataatccacttcgcccaccaggcgtcccagctccgccaacgccgccacttcgacaaacggcgcctgctcccgggcttcgctggcgatgccgtacagctcgacgccaaatggcagcaggaactgcgccacgctctggccgatatcgcccgcgccgacgatcagcaccttgcgcccggccaggctctggcccgtgcggttatcccacttgcgctcgacctggctgaccaggcgcgccaagacttcgcgctcgtgaccgagcatgtaggtgagcacgtattcggccatgacctggccgaagatccccacggcacgggtcagccggtaatggcgtggcaggccgtcggcgagcagcggcgtgataccggcccaggtcgattgcagccactgcggctggtggccctggcgcaacagggtggccagcaggtccggctggccgagccagaccgggcagtccgcggccagcttcgacaattcggcggaatcgccgctggtgagcacttccaggtcaggtgccagctgacgcaacaaacgggcataaatagcgtgatcgtgttcggcaatcagaacgcgcatggttcaaaccttacaaaacggtgcaggcagccaccgacggagtatcgctccatcgatcgcggcagccgccagatagaatcagttccattttcaacgatgccccggacagggcctctacaggtgtccgtcagaccggatcattacggcgcagcagctcttcgggcaagtgctcgatgtactcgtcctcggccggtggcatctgcaggtggtaaccctgcttctcaaggttttccagcacctggtggatgtcctcgcgcgacagcttgcgctccgggctcagcaccaggtcgaaggcgtgctgcggcttgccgaacgccgccagcaggttttccggcacgcgctccagggcatcgctcttgagcacgtagaggtacatctcgttcttgcgcgggcttttgtagatcgagcagatacgtttcatggctgttctccggcggtggccaggctgtcgagcagcgcctggcccatcaattcgcggcgccagccacgcagcgaatcgggcaattggtagggtccgttggggaagccgctcttgagcaggctttccagggttttcttgcgcagcatcagttccggggcgatacccaggcgctcggcttcggcctggcccaaggcgcgcaggcgcttgagcaggggcgaggcttccatcggcaacggctcggggacggccggcggccactggtcgggaccgacgctggcggcacgcttgatcaggcccagcaggaactcgccgtcctggcgcacggtgcgcgggtgcatgtcttcgattttcgccagggcgccgaggttgtccggctggctcttggccaacggccacagcgagtgctcgcgcacgatccggttgcgcggcagatcccgcgcccgtgcctcacgctcgcgccaggcgcagagttcacgcagcaccgccagttgcgcgcgggacagtttccaggccagcttggcgtcgcggtagacctcatagggatcgacttcgcggcgcaggttggccaccagctcggcgccgtcttccagcacccagttgtatttgtcctcggacagtttcggccgcagccgggtgaacacctcggccaggtgcacggcgtcttcggcggcgtagctgacctgggtttccgacagcgggcgttgcagccagtcggagcgggtctcgcccttgggcaactcgatgcccagcacttcctggaccagccgcgagtagcccatggagaaacccaggttcaggtaggcggccgccagttgcgtgtcgaacaacggtgtcggcaggctgccggtcaggcgcagcaggacttcgaggtcctcgctgcaggcgtgcaccaccttgaccaccgcgctgttctccagcaaggccgccagcggctgccagtcgtcgatggtcaaggggtcgatgaggtaagcgcgctggccatcgccgacctgcaacaggccggcgatcggatagaaggtgtcgacccgcatgaattcggtgtcgagggcgacgaatggcaacttctgccactcggtgcagaattgaccgaggctatcgttgtcgcgaatccagtgaatatcgatggccacacggctctcccttgaagaatggcgcgcagtatatatcgcccttggcgatttctgagcattcactcgacaagagcctgcgcgaaatcggcgcccggaccacaagaatagtccgaacgccgtcggctacccctgtttgcgcagaacgtaaacccgccaggcggcacagccgggaatgaaatcctggtggctgagcacttcgaaccccgcgtccttgaactcggtctcgacccgcgcccggctgacgtccatgcgtggagcacgctgcaattgcagggggtcgctgccctccagcggtcgcgcatgactttcaagcgactgtcgatgcgcaccgcgaggatcaccgagtcgcgactgacccgatggaattcgcccagcaacgccaggcgtgcctcgctgctggcgacatgggggaacagttgcaggcagacgatgcagtccaccgcgttggccgacaggccgatgctgaacgacgaactctggaaggtcctgacccgcctgagcaggctcgccgggtgatgggtctgggcgtggttgagcatgtcctgggacgggtccgccgccaggatcacccgattactgtgctcgcccagcactggccagaaacgccccgcgccgcacgcaagatcgagaatcagccccggctcgcccgccaccttcaacgcgcggcgaaccagccactcgtcgcgccacaacgataagcgccgccccagcccgagtgggcgctcgtcgccacagatgcgcgcatgcgcctggtcataacgcctggcgaactcgagctcgaggggggatggagggtgcgcggacatggatctgctggctcttgtaagtcttggatgaaaaacaggttaccgccccgatcgtgaaaaaaaggtcgaacgccgatcacggcttcattgccgcgccagcacgccgtcgaccacgctgccccggcagccggcgaacagatccaggtcgggctggtagacccggctgtcgacctccagcagaccgagcatcgagtggaacaggttgtcctggctcagcggtttttcccggctcagttgcaggcaatgggtgtccaccgagaacgccttctgatagctgtccgagaaccaggccagcatcgccacgtgtttctgctgcgacggcgcgagcatgtagggcgtgccatgcaggaacaggttgtattcgcccagggactcgccgtggtccgacaggtagagcatggcggtatcgaccttgtcctggttgctgcgcaacaggtcgatcagggtcgccagcacgtggtcggtgtacagcagcgtattgtcgtagccgttgacgatgctctcgcggctgcaattgttcagggcgttgctctggcacaccggggtgaagcgctcgtattgcttggggtagcgcttgaagtattccggcccgtggctacccatctggtgcaggaccagcacggtgtccttgtccagggtatcgatgaaatgctgcaggccctggagcaggatctcgtcgcggcattcgctgttggcacagagcgccgggtccttgagtttgctgacgtcatcgagggtcacccggtcgcaggtgcccttgcagccggactggttgtcccgccagatcacctcgagcccggcgcgcttgagcacatccagcagcccttcctcgttcttcgccttgctggcgtcgtagttcttgcgccccatgttggagaacatgcagggcaccgagaccgcggtctcggtgccgcaggacgacacatcggtaaaggcgatcaggccgttttcctggctgagtttcggcgtggtgtcgcgctcgtagcccagcacgccgaagttctcggcccgggcactttcgccgaccaccagcaccgtcagcgacttgcgcgcgtggttttgccaggtcggattgcgctgggcatcttccccgatcttgacgaagggctggcgcgccgaaaccacttgctcgcgcaggtaaccgatggaagcgcccacgtagttgctcggcactatcatcaggcgcaattcatggtgattgcgaaacagcgaggccagcccctgatagttggccagggctaccccgccaatggccgccgcgcacataacggaaaccagcaacttgctcaataactcgcggtgccagcgacgataattgatcggggctttccacaataaccaggaaggcaatacccccagcaacagaatataaacaagcaacttcagggagagtaagtcacgcacttccgttgcattggtttcggcgaagttgcgaaacattccggcatctatcagcactccgtactggctcatgaagtaagccacgccggcactgaccataaacaataaaaccagcaccggcttaagtacccggcgaaacgccagccaggtcaggataaggttgaaggcacagaagatcatcaccccgaaagccacgcgcatggcaatgccgcgggcgtccgaggcggtaatgctaaacaggtgctgccagagcacaaagttgcagcccagtaataaaaaggcgcaggcaatcaacgtcacccattcgggacgcaggggcttgatgttcagcatgatgatcggcgtgttccttgaaagaagtgcgtcgtcaacatgcccgttcttcaatgactgcccacgacagcacgaactttaggtagccgaccatcaacgtttcgtgaaaaagaagccaacaaatagttggcatggccctttgccaaaactttttcggcgaaaacaatccgcaacgccctggcaagcgatgcgccttgccccgttcgagcccggcgcaaataatgagccgccctcggccactccctcgtcatcaaggatcgaccgcatgaaagcacgccttctgctctgctcgctgctgaccctcagcgccccggcctttgccgcgccaagcacctcgcacctggatcaggtcatcgaacgcggccacctgaacgtctgcaccaccggcgactacaagccctacacctacctgcgcgcggacggtgcctacgaaggcatcgatatttcgatggcgcagtccctggcgcaaagcctgggggtcgaggtgaagtgggtgaagaccacctggaaaaccctgatgccggacttcctggcaaaccagtgcgacatcgccgtgggcggtatttccgtgtccctggagcgacagaagaaagccttcttcagcgacaccctgggcgtcgacgggaaaatccccctggtacggtgcgccgacaagcagcgctaccagaccgtcgagcagatcaaccagccttcggtgcgcctgatcgaaccgccgggaggcaccaacgaagtcttcgcccgggctcacctgcccaaggccagcctgaccctgttcgccgacaacgtgaccatcttcgagcaactgctggagaacaaggccgacgtgatgatcaccgacgcttccgaagcgcgcttccagcagaaactcaagccggggctgtgcgcggtgaaccccgagcagtacctgcaatacagtgaaaaagccttcctgttgccacgggacgacgtcgcctggaaaagctacgtcgaccagtggctgcacctgagcaaggccaccggtttctacagcggcgtggtcaatcagtggctggcggcgcccacgccctgagccgtcagccgttcgcgacaagcagccgtcagcagctcgcggaaagcctggcacgcggcgctgcgataagcgcccttgcgccccagcagcgccacgctgcggggcgccaggggcggttgcaggatcaccggcctcaagcctggctgctcctgggtaatggccagcggcaggatggtcgccagctgcccacggcgaacgatttcgacaatagcgccgatggagttggcctcgatggcgatgcgcggcgtcatgccctgctcgcggcaataacggtcgatatgctggcgggtggcgaaatcgccgctgagcagcaccagcggctgccgcgcaagcgcagccgccgtcagttcccgcggtagctcgggctgctgctcgcggctgaccatcaggctcaggctctcctcgaacaaccgctggctgtcgatgtccggcaggtgctgcccggcaaaggcaatgcccaggtccaggcggtcttcggccagggccgcttccagtcggtcctgggtcatctcttcgaggctcagggcgatccccggataccgctggttgaaacgggtcagcagcggccccgccaggtacgtgatgaaggtcggggtcatgcccaggcgcaacgagccgcgccgcagatcctgcacgtcatgcatggcgcgcctggccgcctccaggtcctgcagggccagccgcgcataacgcacataggcctcgccggcgtcggtcaggcgcacggtgcgccccgagcggtcgaacagcggcgcgccgaggctgtcctccagttgcctgatctgttgcgacagcgtcggctgggacacgtgcaaggcttcggcggcgcgggtgaagttgccgtgctcggcgacggccagcaggtaacggatatgacgtagcagcatggtgtctccaggccaggaccgccaactataggcagtacttatggccagcataacaagctggtcttggacgctatagctgaaattttccatccttgcgccatcagcgatgcaaggagaaccaccatgcggcacatcatcgacggctttctcaagttccagcgcgaagcctttccgaaacgcagcgagctgttcaagcaactggccaccacccagaaccccagcaccctgttcgtcacctgctccgacagccgggtagtgccggaactgctgacccagcaggaaccgggcgatctgttcgtgatccgcaacgccggcaatatcgtgccctcctacggaccggaaccgggcggtgtgtcggccactgtggagtacgcggtggccgtgctcggggtcagcgacatcgtgatctgcgggcattcggactgcggcgccatgaccgccatctccacctgcaaatgcctggaccatctgccggcggtggccaactggctacgccatgccgagtcggccaaggtggtcaatgcggcccgcagccatgcctcggacgcagcccgcctggatgccctggtgcgggaaaacgtgatcgcccagttggctaacctgaagacccatcccgcggtcgccctggccctggaacagggccggctgaacctgcatggctgggtctatgacattgccagcggcgccattgccgcgctggatggcccgagccagggcttcgtgtccctggccgaacaccccgacgcctgcgccttggtcggcaaaccgcgacacgcggcttgaacgctctcttttcacaagcctttttcaacgactcgttcaacaaccgtttcaccatcccaacgaggaactcgacatgctgcaatcccaattcgcccaagccccacgcctggccctggccgacaccatcatcgatgccaaggcgcgcaagaacctgtcgtggcaacagctcaccgacggcaccggcctgagcctggccttcgtcaccgccgccctgctcggccagcacgccttgccggccgcagccgccgacctggtctgcagcaagctcgacctggaccaggacgccagccgcctgctgcaaagcatcccgtcgcgcggcagcatccccggcggcatccccaccgacccgaccgtgtaccgcttctatgaaatgctccaggtctacggttcgaccctcaaggcgctggtccacgagcagttcggcgacggcatcatcagcgccatcaacttcaagctcgacatcaagaaagtcgaagacccggagggcggttcccgcgcggtgatcaccctggatggcaagtacctgccgaccaagccgttctgatcgcccgaggcccgcgcaccgtcgcggccccctgtagccgctgccgcaggctgcgatccaggccgcaggactggcccgggcaacgtggtgcttccggcagagcgcgggcgcaggtttgggggctgcttcgcagcccagcgcagcctgcggcagcggctacaggtgttatttgatttttagatagtcctgcacactttctgatttgccccggccacgcccctccccgcctaatcagcgcctgaattgttcaaggtctggttatggaaaacgttcgcgcgacaacccgccccgtgttctggctgatgctcagcgtgacgctggtggccttgaacctgcggccgtcgatggccgccgtcggccccttgctgtccgggattcgtggcgatatcgccctgagtttcagcggcgccgcgctgctgactatgctgccggtcatggccatgggcctggcgatgttcttcggcgtgcgcatcggccagcgcctgggcgaccaccgcagcgtggtgctttcactgctggtcattggcctggccaccctgtcgcggctgttcctcgattcggccgccgaactgatcctcagcgccgtgctcgccggccttggcatcgccctgatccaatcgctgatgccggcactgatcaagtcgcgttttcccgacaatgtctcgctgttcatgggcctgtacgtcacctcgatcatggctggcgcggcggtcgcggcgtcctttgccccgctggtgatgacccgcaccggcagctggcggctgggcctggcgatctgggcggcgctggcggccctggcgctgctgttctggtacgcgcaacgggcggccatgcccaagctgccggacgccgcgacgcaccacgaatcctttgccggcaaccgtcgcgcctggctgctggcggtcttcttcggcctgggcacggcgtcctacacctgcgtcctggcgtggctggccccctactacgtggagcagggttggagcgaacaggacgccggtctgctgctgggatttctcaccgccatggaagtggtctcgggcctggtaacgccggccatcgccaaccgcagccaggaccgccgccgggtgctggtggccttgctggtgctgatcatcgccggcttctgcgggctgatcctcagcccgcagcacctgagcctgctctggccgtgcctgctcggcctgggcatcggcgggttgtttcccatgagcctgatcgtgtccctcgaccacctggacaatccgcggcgcgccggtggcctgacggccttcgtgcaaggcatcggctacctgatcgccggcctgtcgccgctgctcgccgggatcatccgcgaccgcctgggcagtttcgaatgggcctggtggtcgctgaccgcggtcatggcgctgatgatcctgatggtcctgcgcttcaatccgcggcattaccaccgccacttccaatgacccggggaacgcgctcatgaagcccgccagcttgctcaacgcccatctcggcatgctgctgtgggcggtgttgatcgccgcctcgttcttcgccgcggcccgggtcagccaggccgtcgacccgctgttgctgacgggcctgcgcctgctgctgtcggccttgatgttcgtgcccgcgctgtggctcaacggcacgttccggatcagccgcgccgggctgcgggcgcatgccatgcttgggttgctgctggcgatctatttcgcttcgctgttcgaggcgctgcggcatacctcggcggtcaataccggcatcctgttcgccctggtaccgctgctgaccctgctgttcgagggtctcctgctgagcgacaaccctgggaaaaaccgcctgttgccgatgctgctggcggccgccggggccatgctgctgaccttcaggggctcgggccccgagggcatgccgtcgctctacgcggtcggcgtgtatggggtcggttgcctggccatggccggttattcgccgctgagccaacggctcaaagccaccagcctgaaagatcgcagcccggccgccatgaccttctggaacatgctgttcggcgcgctgttcctgttcgccttctgcctgccgggtggtggctggcgcagcgccgtcctgctcactctcaacgacggtgtatggctgctgtacctggccttgttcgccaccctggcgactttttggctgctgcaccgggccatcggggtgatcgcaccggccacggtcatttcctacatctacctgagcaccctgttcatcaccctcttccactggttcgggctgggccggcatcccttgccgggcgagctgctcggcgcgctgctggtgggcctgggcatgctcgccctgatcctcggcagccgccggccagtcccggtgcccggttgaagacgcaacaccaagggacaagccgctacgcgccgcgccatactgcacaggtcgtgttctcggaattaattgtcccttcgctatccgtgaaaccccggggcaaggattcaattaggacgatcgttccgttagcatcaggcaggtttgcgcacgaccgcgcgaggtgctcaacgagacggaactgatgctgaacagtaacttgcttagaaagctcgatatgcaggacctgatggtgttcgtcgccgtgtacgagcaaagcagcgtgaccggggtctcggaaaccctgtgcgtgagtcagtcgaccgtcagctactgcctgaaaaaactgcgcaccggcttcgaggacgagctgttcatcaatacccgcaccggcatgcgtccgacctacaaagccaccaccatgtacagccatgtgctgaagattctcgagagcatcaacctgtgccattccggggtccaggctttcgacccgacccgccaggccgtcaccttcaacatctgcgcgccggaatacttcgaactgctgatcctgccgcgcctgctcaagggcttcgacttcgccgacctgccggtgtcggtcaatgtgcacaagctggaaaccgatatccccgccgaggaactgcgcgacggcagcctggacctggtgatctgcttcggtccgaactttcaccacaaccaccccgacctcaagtcgcaggtgctgctcgaggatgacctggtgtgtgtcttcgacaagcgcgcgacgccgccgctggagccgcgcttcagcctgcagtcgttcgtcgagcgtcggcatgtctaccccacgccctggacctcgaccaccaacatggtcgatggctggctggcccgccaggcccaccggcggcagatcgtcgcgcgctccaacagctacagcgcggcgctgaaaatgatcactggcaccgacttcatcctgaccctgccgcggcgcatccaggcgctgctgaccaacgacgcggtgttcagccattgcgaagcgcccaacggcctgccgggctttaccctggacatgcaatggagcgcccacaccgaccaggacagcgccaacacctggttccgcgagcaggtggtcaaggtctgcgcgcagcagggcctattgtagattcaggccctgcggcattccggttcagtgaccgatgctgagcttgccgtaggagtcgcggtcgatatccaggatctccaccgccaattgcaactcgacgccagccggccattcacagagttcctgcagcaccgccagcaggctttgcgaaagctgcttcttgatctctggcgaacgcccgctgagcaacgacagcttcacatgcacgaacgcccgctcgccgaggccggtgccgacgcgaaacgtctcgaccttgcgcgcgcggctcttgatgtcgtattcagcgaactgcccggatgccaccaacgcgttgttgaaccgcagcaaggccttgtcggcatccagttgcggcaggttggcggtgtattccatatgcagatgaggcatggcagagctccctgaaaggtgggggtgaaaaggcgctccatactacacgccccgcgaccgcctgcctgagtcctctacgaagggataagagactcaacgcgccttgagcggcgccaggtcgcggtcgctcatgaacgcctccagccgcgaacgcagccagcgttcggccgggtcggtgtcgacatggctgagccagaccatggacaggtccagggtcggggtcttgaacggaaacggctcctggaacaactgccccgacgccgccatggccgccgccgtgtagtccggcaggctggcgatcatgtcggtccccgccagcaaggccggcagcgaactgtactgcggcaccgacaacaccacatggcgctgtcggccgatctcggccagccattcatcggcaaagccgctgacattggccgtgtgcgacaccagcacatgcggacgggaacagtattcgtcgagggtcagtggcgtgtcgctggcatcggcgcgcagcacgctgggctggatatgccgcagcagcttgcgcttggcattggccggcagcccgcgggtctggctgatgcccacggtgatgtcgccggcggccagcaagtccgggatccgccagtagtccgcgtgctgcaccacgaacaccaccttcggcgcttcctggcgcaaggttcgcagcagcggcggcaacaggccgaactcgacgtcgtcggacaggccgatgcgaaaggtcatggtgctgctggcgggatcgaaatcgtgggtcaggctcaaggccgaggacaaggcatccagcgctggcgacaggtgctggatcaactcctcggcgcgggcggttggctccatcctgtggcccacgcgaatgaacagcggatcgttgaagatcgcgcgcaagcgattgagcgccgaactgatggtcggctggccaagaaacagcttctccgccgcccgggtcacattgcgctcgagcatcagggtttcgaacaccaccatcaggttgatatcggccttgcgcagttcgttgcgattcatccgcgtgctccatcccaggtcggagcccagtgtagaaaggccccgcaacggcgtctatcgccatcgaaggggcttggttcaaccctgaatgactcaggggaaggtaaaggtgaactccgccgcaccatcggcatcgccgaccttgacctcggcatcgctgccggtgcggatgtagccggcccgcagcgggatgatcgctctgtcgcccacccgttgcatgtcgtagagggtgccgtcgtacttgatccgctgctggttcaggtcgttgatcatgatgatgccgaagcccttggcgctgttgggcgaagccgtcaggttgagcaccgacgggtcggtgtggccgggcactttgtcggtgaaggcgatctgaggcctggcattcaaggcgcactggctcagctcgatgcgaaacggcaccggcgacgtggtcgaacccaccttgggaaaattggccagggagaaacgcccgagcctcaccgggatggtcctgtacgactccaccacgcaggtgttgggaacggtgatcccgcctcccccgcccatattgatgatgtcggggcccatcaacgagtagggtttgcggcagatgccgatgggcatgttgtcgttcggaatggtgacctcccctcccaggctggccacatccttgagcaggtcgaccgcatacagcatcagccccgagctgccggcgacacggtcgatcaccagctcgccgctgggcaactggctggggggcaccgtgaggatcagcgattgcagatagttggtcaccatcagcgagcgttggttctggcctgcgctggggtcaaacagaaccaggttcttttccagcgcgatgggtttgggagtctgggtaatattcctgaggacgccgtccgaagaactcaccgcgatcctgaaaccgatgccatcgatgttggtcggggcgatggcgtcgggcagcggcgtacccgcggtccagtatccggcagagaccagctcgtgggccttgttacccgtagccccaccatatcggtagttggtgatcagggccaccggtcgttgccacaggacggagcctaccggcgtggcgctggtcaacggcgtcacttccacccagggccggccggcgccgttactgaacgtgcagtcgagcgcctggctgtcgagcatggcagcctgggccggcgcgccgatcaagcccggaagcagacaagccagtacctgggcactgcggtagaaccgacgtacgtggccggcggacctgaacgccaataggtgggtcatggggccattctccatgctctgcttgagcccggccgtactggccgacgggctttgttgctcatggaagacccgcatcgcgggtcatcctgaaagaggtgatgaatcctgaaaaaccgatacaccatgccgcagcatggcgtatcgggaacccgcgatacctgggtatcagtgggtggtgccaaggattactggatgattcccaggttcatgccgaaaagcggtacctgggctgcctcgcccaatgccgagttgtatttcatctcgccatagttggcgccgaccaggccgccgtaaatctggtagctcgggtaattgccgttgccattgatcttgccgctggccaccgattgacgaacgttgcccatgttcaatcccaccaggccgcccagactcgtgtaataactgccacttaccgagcccagggccagggagttgaggatctggccatggttctgccccaccaacccaccgatgatgctgcgctggtcgccatagactgcccccttggccgtagcggtttcgatagtcgagcccagggtgcggccgttggtgcccaccagtccgccgacgaagctgttggacccgccccggacttcaccactggcttcgaccgaactcaggtcaccgtcgttgttgccgatcaacccgccgacatggctgttgctgcctgccacgaccttgccacgggccacgacatggctgacgataccgccgtagttgctgccgatcagtccgccggtattgctgctggcgcccgcggtgacatcggccagtgcctcggcggtgtctattttgccgtagaagttctggccaaccaggccacccacattggtgcccgaggtgtcgtagaccttaccgctggtcttgacgtcgttcagcgtgctgttctggttgtaaccgatcagcccgcctgccgaggcgctgccgtaaccgttgaccgtaccgctgaaactggactccctgaccgcactgtttgtgttgaacccgatcaggccaccaatattgctggcgctgttaccccgtaccgttgccgaggagctggaccgctcgaccgtgcccgcctggttgtaaccgatcagcccccccatattcgtgcccacataactgcacgagtagttaccgactgaaccgctgctggaagagtcggcgatataaccgcccctgttgctaccgaccaggccgcccgcaccacctgcgaagttacgcgccaggtacccgccgatggtgacattcgccaaactgttggtaatgctcgcggagcccgcaccacctgaaacgttttcaccgaccagcccccccaccgacgtggtatagccgttgccattcacgtaggagttgaccgccaccgatgcgcggtcgatcgcaccgcctgaattgagcccgaccaggccacccacgacgttggtgttcgaggcgttggcgttgacgcgcaggccagtggcgctgacgttggtcagagtgccggtgttccaccccaccaggccgccgatatagctgaagcctgctccggaggtagtgccattgacggtcatgttggccagtttcaggttactgatactgcccgagtttccggagaacagaccaaccgtaggcccggtgttggtcaccgtgaaaccgctgacggtattgcccaggccatcgaagacgccagagaacgcgagattgccaccaatggacttgaagttgccgtaccccttgatgtcggtccccaggacatacaggccattgaggttgttattgaccgcctgcagctgggcggtgttttgaatgacatcgtaaagcgcgccgttcgaatcgaacgagaccccggtaccggacagagtgaccttcgtgttctgacccaaggcatagccgctgccatggttcatcccgaggctggcattggcaccactgagggtcacgttgccgttgagccggatggctttatcggcattcatctcgacccgagccttgatgccggtgctggccagtccgccattgacctcgatgttgcgcttggaagacagcttcagttgattgccgctgttccaggtaacgggaccgcccaccaccacatcgccgacactgctggccagctcgatgttggtggtcgccaggttgttcgacaaggtatcggcgtaggcggtgtcgctgcccgatgccgctgtcggattgaccttgacctcgcgcgaggtgatcttccagttgccggtctggccgttgctggccagggtattgacccgggtcgccagttgcacctcggtattcgcgcctttgacctcgatcacaccgccgttacccacggtgccgatggcgctggcggtcatcgccccgcccaccagtaccttgcccatgtcgccgccatcgagggtgatcttgccggccgtgccacgcagggtattggcctcgatggtgccctggttgttgaccacggtctgcaacatgtcgccggcactcttggcggtcatcagcacctggccaccgtcggccttgagcagaccgccgtttttcaccagggcatccactgcggcaccgtcgacttgcaggttgagcaggttgttgccgtcgaagttcacggtgaacttgtcccccgcgcccagcgccacacggcccatttgcgcctggatcaccccatcgttgcgaacgttggtccccagcagcgccacgctaccgccctggtcggcaatgatgtcgccgttgttgatgatctccgccggcgagttgcccgagaacgtgtagttgccggcctcgaagtctttattggcaatgtcccgggtcgaagccaccagcccccccacgttgacctgggcaccctggccgaagactacgccgttggggttgaccagaaacacctggccgttggcattgatctggccctggatatcactggcattggttccgaccacacggttcagggcaaccgagcttttagtgggctggtggaaggagaccttctcaccctttttgacgctgaagtcgttccagttggtgatcagcttgtcacttttctggttgatcgacatttccttgccatcgttgaaggtcaggatattggcgtccccggacacatgggtatttcccgtcggcagggcgaaagccgaggacacggcgcccactcccagcaggctgacagccgccacgaccatccccttgcgcgcacccgacttgcgccggcgatgtgccccttcatgagccacattccagcatgccagggcctggttccaaaccagtgcatacattttgttcacggtaacgccctcttcactaaagaacgttctgcaaaccatttgcagaacgacaccactcctgctacgagcaggtactagaaatattgcgtcgcgttcatccagacctgggggcggcgctccggcttgtcccgggtcttgccgttgtcatgcagcggccaggcgagcgtcaggttgacttgctgcgaaggccccacccagctggcaccgatgccggtcgccgtgatccggcgggtattgttttcggaggtcctgggttggcgatcgaccttgaccgtgccgttgtcggcgaaggcgctgagctgccagcgcggggccagggcgtagcgcagttcggcactggcctgccagccctggtcgccgctgccggcgcccagtggatagccacgcacaccgtagggaccgccaaaaccgatcttttccgagttgtccaggttgctgttggcccattgcgcactcagccgggtatagagctggaaacggtcgctcaggcgctgcaggcgcgcggcgttgagattgagcttggcgaacccgcccgagatgcccgcggcacgaccatcgcgaacctcttcctcacggtcgccaaaacgcaaccggccgctgccgtaggacagatcgaagaagttctggcctccccggaaaaaacggtcctggttgttgccgctgaggctcagggtccacaggccgatccgcttgcggttactgaattcgaacaggtcgatatcgtcgcgtagccgtttgtcttcgtactgcagttgcgcagtgaggtcgaaggtgcggctgcgtaccagcggctgggcgacgaaaaaactgcggaagctggcggtaccgtggtagtcgagaacctcgaagtccctgtacaggcggtagctcatttccgagtacgcaccgccgatgcgggtcgaccagggcccgaccggtaactggtaggccgcacggtaatagcgctgcgattcgtcgctgcgcatcgcccgcaggctgagctggtcgccgaggcgcaaggggttgttgagattgaggctgccacccaggcggtattcaccggtgtagtagccaccgaagttgtccgcctccagggtgccgttcagcaacggcccgggctcggtatcgatcaccaggtcagtggtcccgtactcctggccaggacgcaaggtgccgcgggcctggaccccgggcaggtcgctcaacagcaagaggctacgctccaggtccgcgtcgtataccgcctcgccgctgttcaacgacgacagcggcgcccgcaccacctgatccagcgcgcgcgaacggttctgcacttcgatgcgcccgtaacgcccctccaccacggcgatccgcaccaggccgttttcaatatcctggggcggcaggaaagcgcgggccagtacatacccctgcttctggtagtagtcggtaatacgctgggcggctgcgcgcaaaccgttcaggtccagctcctggccctgcaggtcggccagcagcggctgcaagcgctcggtggcgaaaacctggttgccctcgatggcaaacgcctggacctgcacccggatcccggaggtgtccggggctgccggcacggcgggtgtctcggccttgggcagatccaactccagctccgaagggactggctggaccggctggaccgactcgatgtcacgcatcacctgaccagcgttaggcacctgcaaggccagggcgatatcgggcaccgccatgggcagcagcgccgccagcacgaaacatgacccacgccgccccagcctcatgcccaccggtcgcgcaccctcgggcgctcgaccgcaaccgcatgacgacgcactcgccgcgaatctgtccatcgcaaaactactgttgtaaccgcgcacttccactcagcgtctccccgctgtctatcgccacctggtaacgaacgaccgtcgcattggcgacggctgccttttttgttgcgggcagggcgatacgtgtcgtgccgaaaggctcgagcgtgatcccctgccaactgatcatttgagccccgctgcccagttccaactgcgggatggatacgtagtaaggcgcccggctggtggccaacaacgccatctgcccgtccgctcctggggtcttgtcgaggctccagaccacttgcccgattgcctcgtccgccttgccggcaaggcccgaagggcggtacagcagcttcatgcgcatgcgataggccaagcgcagcacattgctgtcgctggtcgtcaccggcggcacttcaaggaaattgatccagaacaccgactctcgatcgccgggcaagggttcgccggtgtaacgcaccaccagggcactgcgctgttgtgggtccagccgtgaaacaggcggcgacagtacgaacggcaccgtcagacggctcgggtcggtgcgtgtatctccccggtccagccaggcttgcaggaggatgggtgcatcgccggtgttgccgaccctgaccgtcaacgccggggtattggccgggtaaatgaagcgcgtaccggtaatggccagcgccgcctgggcgtcggcgcaaagcgacatcagcagccaggccgccatcaggcccccacagattcgccgagccatggccgaggggcagcacaagccgcctgcctgtcgcatcagccgttcctcgtctgagccggagccccggcagtgtcgggaggtagcgggcggcatggcaggtcgaacacctcatagcccttcgcctcaaccgccttgccagacgctgcatcgcgcttgggcaagcggtagtcgatcaggcattgctgcccaggctggtcaccccattcgacgcggatcgagccctggtccttttcgctgcgcagcaccaggcggctgccctggccgaccgcgcccatttccaccccgctctcggcgtcggtggcgatcgcggcaaacggcaggagcgcgccattgggttgcaggctgttgatcaggaaagcgcgcgccttgcgggtcgggtacgacagcatcaccacggcccccgccaccggtgcggtgttgcgcgaactcacctgcaactcgacgtcgtcgggcatgcctttcgggtcgatatccacggtgttgagctggaaaggcgtcaggctgggcactaccgcgtaaccgctgccattcacccgcgcaccgctgtagccgaccccggcgcccttggcatgaggtgcgtagaccaggccgctggtctcgctcagggtctgggcaaacgtcaggccgccggggtgcaggatcatgccgccggacgcgccgatggagccctgacggtaatcgctgccctgggaaaaactggaacttaaggccacctggggcaaggaataattgagactaccgttgtggctggtttcccgttgcttgtcatcacgggaaacggacacggcataggatgctttgcccgcctcgtccactgtcccggaaacgccgctggtcagatgagttcccgtgctctggtcgtgactgacgaagttattgagcaccgttgcgccccgggtctcacggcccagcgggatcgtaagggtcaaactcaaggtcgtattgctactgactgcccgacgccctgaataccggttctgtcccagcgtgcgctgtacggcgaaggaatagctattgccccgccactgattgctgtaacccgtggaaaagctcagggccttgccttgtctgttccagtaattgagcgccgaaccactggcgtagaaattcccgccagtggccctcaactgctgactgatattcacatccagccggtcacgcattcgggagaaggcttccacccgttcgccgctctcgacgaagtcctgcaacgcgaccgcgtcatgcagtcccaaataaccacgggtcgagtagcgataagccagtaacgagaagttggtaccgctattgggcaggttcttgctataggacagacgcaggctcgtccccttcagacggccccttctgggcacgttggttttggcctgggtcacatcgaaagcaaagccccccacatcggtattgagcgcgctccccatcagtaccgacatataactgcccgtgacagcactgccgatgtatccggtaatgtcgttatccagaccgtgctgggctgtcccttgcagcacatactggttactgccacgcagcccaggatcgatgatctggccggcggtgaagccataccgggagtttccagggcgcagtaactgaacagtcgtggcgaagggcacggtgaagctgctgctcttcccgttagcctcggtcacggtgacgctcaggtcgccaccgaagctggcggcctgcagatcgctgatctcgaacggtccaggcgccaccgaggtttcggagatcagataaccgcgctgataaaccgacaccttggcgttcgagctggccgtaccgcgcaccaccggcgcgtaaaagcgttcggtatcggggagcatccggtcgtcgctggacagctgtaccccacggaacgataccgagtcgaacagatcggcatcggtggcgctctcccccaccagcagttgcgaacgccaggccggcagctcggtctgggcataaatttgcccgcgctgataatggccgcccgattgcggcgaccaggtcagggtgccgttatgccgtaagcgcaccgagccggcattgatccccatgttcagcccggcataaccattggtcatggtgcggccgctgttttgcacgctgaacaggttagtgttgtagttgagtagccccgcggaaacgccatgatcccagttggccgggtcgacgtaggttttcgacaggttcttctgcaggaaatattgcgggaccgaaagatcgatcgtcagctccttgagatcgatcttcgtggtgagaccaggaatgtagcgagccaggtcggcgcaataggtgccctccggcatgctttctgcggaaggttgcgccgaagccaccttgtccagatcgataccggcgcgaaccagcaacgaacgctcataacaaggctggccgccttgcggcccatgcgtgtcgcgaaactcgatgttctgcgtggcacgccactgaccgtttaccaacaggtcgatgcggtaattgcccggaatgagaaagccctggcgctcaaagcggctggtatcgatgggggcaccttcggtctgaaacaacatctgcgaatcgaataccacgccctgccccgcggactcggcagtggaagttccagcccatgtctcagtcgccatgacaatagccgccgtagaaacaagacatagaaaaaaccggcctgggctcaaaccgtacgaaactaacgcacaagcaaaaacaaccagacaactacgctggacgttcaacatattcgataccggcatgcagccaggtcatagagatgacaaaaactgcagggtgataaaagttacaggggcaacggtttttcaagtacgcgccgcccaccgaagtcattaatgacctcgtaatgaacagaggctttgcgataggtctgaggagcctgttcgggcaatgggaaaaaactgctgctgaaaggcgcgatcatttcgtctttaactgcaacccgtcgcccatccagagcaacctcgatcttgccgaaagaaacgtaatacgccgtcggattgcttacctgaatccccaggcgatgcccgaccttacctttttcatccggatgactggcttgcttgaattgccaatcgagcttgtttgccacctggtccacatccgacttcaagttcttgggtcgaaagaacactttgattcgggttctgaacgtaaactgcaagacattttcatcgacttccttgcgcggaggcgtttccagcacattgagccagaacaaggactcccggtcttccgcaagtttttcacccgtataggaaacacgcagtgaagctgaactatccggatccagacgaattaccgcaggggacagcaaaaatggaacctttatctcctcagggcctttagttgagtctccatcatcaatccaactttgggccaatgaagcagaggcaccggtattgttcatttttatagtaacttcacgagcatccgacggataaaccagccgagtgccctggataactaccgacgcctgcacgattccagaacatacgcccaagaacatgacgccaagaacgaaagaagaaaaaatacgcgctttcggcgtcatgaatcactcctcgggcgttggcctttacttatacgacagggtgtatcgaacgaaggagttacccgaacccgcgccaacgctagccgcggtcgcaacatagttcgccttgaacttcagggttgccgtgttgcctgcaacggtggcgacctgtggcgaggcttccgactgaccgagtgggactttcgtaccagctgcgacattgtcgttgaacagctggatctgcacgccagtagcaggcgcggcgccgatcagcttgaggttcccggtcaccacatcgacgttgcccacctggtcaaaatcaacgacgacctttgttccatcggcacattgcgcgccggacagcaccaacgcgaacggttcaaatggagaagcatcgccaatggccttgaagatcgaaggagaaatgcgccccaactccacgttggtgatgttgttttcacccggtgcctggccgttgatattgcaagtcacgtcagtgatgctgccagagaagttaaccactccatcagtggcatgagataacgaaggaacaagtgcggcaagcatcaagctggaagttgccagggatagtaaagatgttcgtttcatgtgatttccttgttcacgttgatcggcataaagaagtgcgatctacttgatcgtcctcccggctcagctatgaccaaatcacgccagccatggcagtccatgcctctctcattcaaagtctaagtcgattggtcgacaacaatagcaagctccttggctgcccatgaaggacgcccaaaggaagccgtagcttaccgatcaaccttcgaatttgaattgagagacggccgaagcacccatcagaaatatcttaataaaccgtccattgatttcgtctttacttatgagacaagactgtgtacttcttcaacgcgttgcgttcagttgaactctgccaagtgctcgcatcgcagtagcctgagccaggctaactagctactcaataaaaatgaaaggagtctaccccgccggcctgcgcagtgagcgccgacaaaaggcccaacctcaatgagaagaattgaatatagagagtaaaaatataaaacctacacgcataatcaatatagagagagcacactatgggatccatagtaatagtcgacgaccaccctctggtcagggtcgccttgaaagtcatacttgaacgtaacggacaccatatcgccgccgaggcagacaatggcgtcgatgccattcaagttgttcgcacacataaaccggaccttgtgatacttgacctcgatctaccgcaactggacgggttatcggtactcacccacttcaaggcaaataacttcctagtaaaaacgctgatattgacttccagcgactcaaaaaatttcgccgtacgttgtttgcatgggggcgcagcaggcttcatctgcaaggacgaagcgctggatgaggtgggagatgcagtaaaggcactgttatcagggcatacctattttcctgaaagttctttgctcctgttgcaggaaagcattcacaccaaccagatgcaaagcattgccgcctctcagctgaccaatagggaaatcaccacattaagattattagcgcagggccttaacaatagggagatagcagcgactctgctcatcagtcacaaaacggtcagtacttacaaagtaagactcttgaaaaaattcaataccaccaaccttctggccctgattgaaatagccaggcagaaaggaatcatataggcctcttgcgaaacccagcagcgcatggacatctgtccgttccagaatcagcgtcttatcggttttacgacgggacatcgagcacgactcccttttagagcagcagaggaatcagcgctcacgaggcagttctctcagattgattggcccatcatcctgtatggctacaagacagatgtccttgaggttgagcaacgcctgctcgaccaactgcgccctttccaacagcaccggccaggtccctgcgacactgacgtccctcagctgctggcagctggagatcagcggctggtacttcaacacacaagctgcacccgctatcttgtggcacagcctggcaatggcttgccgatcgttttgttcgcagtacgcccgcaacagctcgaggtctttgatctggtaggtccttacgtcgtcgatgagccgtcgcgcgacttgctcattgtcgccagcaaggtccatgagcctgcccagcacctctagcaacgacaccgcggaaccgacccggatagcgtgaaacacctcctcacccgcgcttatgcctgcgctgaagcctgctgcctccggcgttgcaccggcctgtacgtcctgcctattcatatctgcctccctgcctcacctgaatatgccgcggcccgttcatcgaatacgaatcaggctaggcaaaactcctggaagcgaatatcagacgtttctcaaagcgctgaacagggcggttttactcagggagtccccccagacattgaagtccggagagcatgaaaaaacccgccagaaaaatgctctggcgttttttaatagctgacgctgcaacttgtagacacccagcactggcatgacccagccagcccttgccgcataagggtttcagcccattgagccgtatcagtgccaggtacctgcgagcatttcgccaaaaacaaatcgacataatattgacaccaaagcacccgcctgtcggaatattggcacttcgtgctgttactcccggttaacacctttacaaggcctgaccccacaactaaacaactatccaactgatatcaggaaaggccgtatccctgaagcagaacgattcggtttcatccagccattacttcaggagtccctttcatatgggtgctctcaggctattgcgctccacgcgcagcgcagctccaggcttgggctcatgttcgcccgaccgctcctgcgattcgcttctcaagtacggcgaacttcttcacctacgcgccacctgcgtccctcttccggcaggcccagacggccaacgatgtccgggatcacctcgtaccgctccttgacaccctgagcggtacaagcacgggacttcgtcctgccagcaggacctgacgattctaaaaaaaacattctcgggagaaagacatggctaccaccacaacgaccagcggcggcaccgcaacttcgttttccaatacaccgcaggcgcaggacgacattttcactacaggtgtcattggcacgagcagcgcagccatcactgaagacctgttggggatcgtgtatctggacgtcatgtccaatgacctcggcggcaatgcaaagacactctggtcactcgataacgcgaccagcctttctactgccaccaaggtttatgctccggccgatctcctggtccaggacacgggcagagtcgaggcgacgagttccgacaccagcttcaatggcgcaaaaatctggattacgtcggatggaaaagtcggctacgacgccgcgaccttatcgactgctttcaaggcgcaacttcaggcgcttgctgccggagcgtccctgacagacagctttacgtatgcgattcgtctcggcaatggcacgctcagctgggccactgcacaggtgcaatttgcaggtgcgaatgacagcgtgacgatgagccttggcgcccaggccggtaccgtaaccgaagatgcggccacgacacctagcccgaccgactcgcacagcgcgacgggcacgattgcgtttaacgatgtcgatctgagcgacacgcataccgcctctttcgtggcggcgccaggcaatgccacagcgctgggcaacttcgtcctcgcttcggtgactgaagccgccaatgcggccaacggcaccgtcaactggacttataccttgaataacgcggcagcccagtccctggcccaggggcagacggccagcgaaacttatgtggtcaccatcagtgacgggcatggctcgtcgacaacgcagaatgtgatcatcaccatcaccggcaccaacgaccaggtgcagatcaccagcggcgtgcagaccggagatgccaaggaagacagcggcgactacgctgccagcggcaacatcacctttaccgacgccgacctgatcgacacccacagcgttaccgttacgccgggcgcttccggctacctgggcaacttcgctacagacccgctgaacgacagcaccggcacgggcagcggctcgctgggctggcacttcgcggtagacaatgccgccctgcaattcctgggcgaaggccagaccatcacccagacctatgacgtggcgattggcgacggcgcggtgcagaccgtgaccattactatcaccggcaccaacgaccggccgacgctgacgattgccgacactaccggcgccatgagcgaaggcaacgctgcggccacactgagcgacagcggcgccttgagctttgccgacctggacaacatcgacgcggtgaccgtgtcgcacaccgccaacggcaacatcgcctggagcggcggaacgctcaatgcgggcgtggcttcggcactggtcgccggcttctcggtcgatcagaacagctgggactacagcagcagccagaacctcgacttcctcggcgcgggtgaaaccatcaccttctcgtacacggtcgtcgccaccgatgacagcgacgcggcaaacgcggcttcggcgacgcagatcgtcagcatcaccattaccggcagcaacgatgcgccggtactcagcttcgccaccggcaatgatgtcggcgtcgtgcaggaagacaccaccctcagcgtcagcggtcaattcagctcgaccgatatcgatcacgctgccaccgcgacctggagcattgtcggggcaaataccggcgccttcggctcgatcgccgtcgatagcagcggccaatggacctacaccctggccaacggcaccgatggagtcgccagtgcggtgcagtcgctgaaggtgggcgagagtcatgacgaagtgttcagtgtgcaggtcagcgatagcctcggcggcgtggatactcagttggtaactgtcaccgtcaccggcagcaacgacgcgcccgtgctcagcttcgcaacgggcaatgatctcagtgccgtgcaggaagacaccaccctcagcgtcagcggccagttcagctcgaccgacatcgaccacactgccacggccacctggagcatcgcagggtcaaacaccggcacctacggttcaatcgccgtcaacagcaccggccagtggacttacaccctggccaacggcagcgatggcgttgccagtgcggcgcagtcgctcaaagcgggtgaaagtcacgatgaggtattcagcgtgcaggtcagcgatggcctcggcggcgtcgacactcagctggtaaccattactgtcaccggcagcaacgacgcgccggtactcaatttcgccaccggcaacgacgtcggcgctgtgcaggaagacaccaccctcagcgtcagcggccagttcagctcgaccgatatcgatcatgctgccacggccacctggagcatcgcagggtcaaacaccggcacctacggttcaatcgccgtcgacagcaccggccagtggacttacaccctggccaacggcaccgatggcgttgccagtgccgtgcagtcgctcaaggcgggcgagagtcatgacgaggtgctcagcgttcaggtcagcgatggcttgggcggcgtggatacccaactggtgaccgtcactgtcaccggcagcaacgaccaaccaaccctgaccattgccgacaccgccggcgcgatgaacgaaggtgatggcactgccacactgagcgacagcggcgccctgagctttgctgatgtggacaataccgacacggtgaccgtatcgcacactgccaacggcgacatcgcctggagtggcggcacgctcaatgcgggcgtggcttcggcactgatcgccggcttctcggtcgatcagaacagctgggactacagcagcagccagaacctcgacttcctcggcgccggtgaaaccataaccttctcgtacacggtggttgccaccgatgacagcggcgcgactaacgctgcctcggcgacacagaccgtgaccatcaccctcaccgggaccaacgaccaaccaaccctgacggttgccgacaccaccggagcgatgaacgaaggcaacggcactgccacattgagcgacagcggtgccctgagctttgccgacctggacagcaccgacgtggtgacggtatcgcacaccgccaacggtgacattgcctggagcggtggcacactcaatgcgggcgtggcttcggcactgatcgccggcttctcggtcgatcagaacagctgggactacagcagcagccagaacctcgacttcctcggcgccggtgaaaccataaccttctcgtacacggtggttgccaccgatgacagcggcgcgactaacgctgcctcggcgacacagaccgtgaccatcaccctcaccgggaccaacgaccaaccaaccctgacggttgccgacaccaccggagcgatgaacgaaggcaacggcactgccacattgagcgacagcggtgccctgagctttgccgacctggacagcaccgacgtggtgacggtatcgcacaccgccaacggtgacattgcctggagcggtggcacactcaatgcgggcgtggcttcggcactgctcgccggcttctcggtcgatcagaacagctgggactacagcagcagccagaacctcgacttcctcggcgcgggtgaaaccatcaccttctcgtacacggtcgtcgccaccgatgacagcgacgcggcaaacgcggcttcggcgacgcagatcgtcagcatcaccattaccggcagcaacgatgcgccggtactcagcttcgccaccggcaatgatgtcggcgtcgtgcaggaagacaccaccctcagcgtcagcggtcaattcagctcgaccgatatcgatcacgctgccaccgcgacctggagcattgtcggggcaaataccggcgccttcggctcgatcgccgtcgatagcagcggccaatggacctacaccctggccaacggcaccgatggagtcgccagtgcggtgcagtcgctgaaggtgggcgagagtcatgacgaagtgttcagtgtgcaagtcagtgatggcctcggcggcgtcgacactcagctggtaactgtcactgtcaccggcggcaacgacgcgcccgtgctcagcttcgccactggcaacgatgccggcgccgtgaaggaagacaccaccctcagcgtcagcggtcagttcagctcgaccgatatcgatcacgctgccacggccacctggagcattgtcggggcaaataccggcgccttcggctcgatcgccgtcgatagcaccggccagtggacctacaccctggccaacggcaccgatggcgttgccagtgccgtgcagtcgctcaaggcgggcgaaagtcatgatgaggtgttcagcgtgcaagtcagtgatggcctgggcggcgtcgacacccagctggtgaccgttactgtcaccggcagcaacgacgcgccggtactcaatttcgccaccggcaacgatgccggcgccgtgaaggaagacaccaccctcagcgtcagtggtcagttcagctcggccgacatcgaccacgatgccaccgccacctggagcatcaatggctcgccaactggcagctacggttcgattgccgtcgacagtaccggccaatggacctacaccctggccaacggcagcgatggcgttgctagtgcggtgcagtctctgaagacgggcgaaagtcacgatgaggtgttcagcgtgcaggtcagcgatggcctcggcggcgtggatacccagttggtgaccgttaccgtcaccggtaccaacgacgccgccgtgctgtcctcggccagcgtcacgctgagcgaaaccaatgctccgctaaccaccggcggtagcctgaccgtcagcgatatcgacagcccggaaagcttccaggagcaaatcgacactgccggcagctacggcaagttctccatcggcaccggcggtgcctggacctacaccgccgactccgcccacaacgagttcgccgctggcaccacctacaccgataccttcgcggtaagcagtgccgacggcaccctcacctcggtcaccgtgcatattctcggcaccaacgatgcggccttgctatccaccggtatcgccaacctcaccgagaccaatgccgccgtcgacatctccaccgccggcaccctgagcatcagcgacgtcgacagcgccgcgaccttcgtcgcgcagaccaacaccgccggcaactacggcaagttctccatcggcaccggcggtgcctggacctacaccgccgactccgcccacaacgagttcgctgccggcaccacctacaccgacaccttcgcggtgagcagtgccgatggcaccctcacttcggtcaccgtgcatatcgccggcagcaatgatttgccgactatcacctccaacggcggtggtacgacggcttcgatcagcgtcgcggagaacaccgcggcagtcacgacggtggtggcgaccgatgttgatctgccggcacagacactgagctacagcatcgtcggcggagcggatgccgcgaagttctcgatcgtttcaggcacaggtgcgctgagctttatctctgcacccaactttgaagcgccgaccgattcgggaacgaacaacgtctatgacgtgattgtgcgggcgtcggacggcacgctgtttgacgaccaggcgatcgctgtaaccgtgacgggcatcaacgacaacagcccggtgatcacctccaacggcggtggtacgacggcttcggtcaacgtggcggagaacaccgcggcagttacgacggtggtggcgaccgatgctgatctaccaacgcagacgctgagctactcgatcctgaatacggccgggacggacttcggcaaattctcgatcagttcgagcggagtgctgacgttcaattcggcgcccgattacgagaatccccaggatatcggtggcaccgacggcgacaacgcctacgttgtggacgttcaggtggccgacggcaatgacggaaccgacacgcagaccattacggtaaacgtgcagaacgtcgttgagacgcctgtcgatagcgtggcgccaacggtgacagtgacagggacggccttaggcagttcgattggctcgacgtcgacggtcacattccagttcagtgagacagtgagcggtttcaacctctcggatgtctcggtgactacgacgagcggaacgccccgcggaaccttcagcaactttacccaggttgacggcgacacctacaccgcgacgctgaccagaacgctgggcggcagcataaaagtcgacgttgccgcgaacagctacaccgacctggcgggtaatcccggggctgccgggagcagtgcaaaccttccggcaggcgttgccggcgagcccatcaatctggccctcgacattccactggccgagattaacggccccgtaacggtggccatcagcggagttcctgcggggtggatgttcaatgctggaaccgacaacggcgacggcacctggaccgtgcagaccaacgatcccggcgctttgaccgtgacaaccccaagcgacttcgcgggtgcattggtacttgatgtcaacctgtactggagcaacagtgacggcagcaccgcaagcgcctacgtgttcaacaacgtcgaagtctatgccccaggctcgccaatctttgccttgtccgctgatgacaacctgaccggttcgtccggtgccgacacgttcgtcttcgcccagccaatcggtaacaaccagatctacaatttcgacgtcacggcggacaagatcgacttgatcggcttcacaggcgtcaccgccttcgctgacttgagcatcagcgacgacgtaaacggcaatgccctggtcagcatcggctccggccagacggtcaccctcaaaggcgtcgatgcagcagacctgagcgaagcgaacttccagttcgatagggacccgctcacccaaaacaccgggaccctcaccattgccgacggcgcgatcatgccgttcggtggcggcctccataacagcggcaccatcgaactcggctccgccggcaacgagacccggcttgagattctgttccgtggcgcgaccttgaccggtggcggccaggtgctgttatccgacaacgcgcaaaacgtgattttcggcggtagcgccgacaccgtgctgaccaacgtcgacaaccgcatttccggcgccggccagttgggcgccgggcaaatgatactggccaatgcggggctgatcctggccagcggtttgaacagcctggtgctcgacaccggcagccacaccatcaccaacagcggtgtgctggaatccaccggcacaggcggcatgacggtggccagcacggtcgaaaacaccggccatctgtgggccaacggtggcgacctgaacctgctggccgacgtgaccggcaatggcagcgcaaccatcgatggcgatgccagcctgaccttcgccggcgccgcacacacgtccgtcgccttccacggcgaaggggcggggtcgctggtgatcgcccaggctgaagcggcgggctcgctggtcggtatcctcggcctcgagagcgatgacttgctgacgttcggcgatctcgcttttggcgccaacacccagctcagctacaccgccaacgcctctggcgccggcggcctgctgacggtggacgatggagcacatcgagccgaggtgaacctgctgggacactactcggtggaagacttccaggccaccgacggtggcgaagccggcacccaagtcagcttccacggcgaatccagcggcacactggtgggcagcatgctcgctgatacgctcagtggcggcgacggcaacgacatcatcgtgggtcgtggcggcgaggacacgctcagcggcggcgcgggagccgacatgttcgcctacctcaacgcgaatgaaggcggcgaccatatcctcgactacaactacgccgaaggtgacaccctcgacctctccacgctgctcaacgccaacttcgtcagcggcaccagccaggtagccgactttgtccaactggcgcagtccggcagcgacatcacggtgcaggtggatcccgatggcgcgaataatggcaagcacttcgtcgatgtggcggtgcttgaccacgctggcacgcccagccccgacctggtacgcacctggttcggagaggccgaccatacgctgaccgcgtgattcattgggcttgagctggctgggagggtaaatatgctcgatgtgaatcgaatggcccccgcagtcagcttttcgaaatccaaatgggggaacaagcgggggaataaaaacagccagaaacgacgaagcccctgaaaactttaacgttttcaggggcttcggctacttcaataatggcggagagatagggattcgaaccctaggtacccgcgaaggtacaacggatttcgaatccgtcccattcggccactctggcatctctccaacggcgcgcatcataacagcacctttgcccgaagcgaagcccctcgggcaaactttttccgtgctatcagtcggttgcgtcgattacagcggtacgcccagacgattggcgacttcttcgtaggcttcgatcacatcaccgagcccctgacggaaacggtccttgtccatcttcttgcgggtttccttgtcccacaggcggcagccatccgggctgaactcgtcgcccaggacgatctggccgtggaatacgccgaactccagcttgaagtccaccagcagcaggccagcgtcgtcgaacagcttgctcaggacttcgttgaccttgagcgacagttctttcatgcgcgccagttgctcggcggtgccccaaccgaaggccacgacgtgggattcgttgatgaacgggtcgcccttggcgtcgtccttcaggaacagttcgaaggtataagggttgagtttcagaccctcttccacacccaggcgcttgaccaggctgccggcggcgtagttacgcacgacgcattcgaccgggatcatgtccagcttcttcaccaggcactcgttgtcgcccagcagtttgtcgaattgggtcggcacgccggcctcttcgagcttctgcatgatgaaggcgttgaacttgttgttcaccatgcctttgcgatcgagctgctcgatacgcttgccgtcgaacgccgaggtgtcgttgcgaaacagcaggaccaggcggtcggcgtcgtcggtcttgtaaaccgatttggctttgccacggtagagttcttcacgtttttccatgatgggctccgcttgctaagtaggtgggctaggcgatgtggcgccagtcgagccctgaatcttgatcggccagttgcagccagtccgggtcgcacccgagggtgtcgacaaaacattgccgggccagctgcggcaggttgttcttgctgctgaggtgggccagtaccagatgctgcaggtcctgccagcccaactcggccaccaggcttgcggcctgatggttgttcaaatgtcccatttccccaccgacccgctgcttgaggaaatacgggtagtaacctcgggccagcatgtcgcggcagtgattggcctcgatcatcaaggcatccagcccgcgatagcggtcgatcaccgtgtcgcagtaggaacccaggtcggtcagcagaccgaaacgccgctggccgtcactgaacacgtactgcacaggctccagcgcatcgtgggcgacgcgggtcacgtcgatactcaaggcaccgacctgaagcgtctcgcccccggcgagaaaacccgcggcgtccaccggtttgcgcatcccgcgcaacgtgccgcgactgaggtagaccggtaaattgtagcgccgagacagcaaacccacgccatgcacgtggtcggcatgttcgtgggttaccagaatcgcgcttagctgcgcaggggctacccccaggcgcagcaggcgccgctcggtttcgcgcaaggagaaaccacaatccaccaggacgtaggtgtcgtcactggctatcagcgtgccattcccttgactgccactgccgagaacggcgaaacgcatcggatcagcccaggttgtcctgaatcacagtcaagaccttgcgcgccacttcaggcggcgcaacggtattgatgtctttctcgacggtgacctggacgttgtcgcccaccttgctcaggcgaacctgataacgctcggcgcgggcctcgatttcttccttggccggtgcgctgccgaacaacttgccgaagaagcccggctcgtcgtttttcttctcggctttttccgccaggttgatgtagtacagacccaggctgcggttgatgtcttcaacgcgccactcgccctgttccagggcgcggccgacgctcgaccaggcacgatcgaggtcttcgccgagattgagcaccacgttgccgctgccgtcttcggtgaggctgacacggctaggggtatcgaaatcacgcgcggccagcagggagaccgaaccgcccttctcggcgctgcggctcatgctggcgagcatttcgtcgaccagcgcggcatccaggctggtgttgaccgagcggttggtgaaatcgacgctggaggtgctgccgacaggacgctcggcgctgaccacgtagacttcactggtattgcgctgcacgcctggctcgatacgcacccgcacgcgggtttcgttatcggccgaacctacgctgcccaggcgcttggccatggatgcggagagctcgtcggaacgctgccaggcggtggtgaactcgccggtttgcggacgttgctcgtcaatacggaaaccgttgtcctggaagaactgcatggccaccggccagacttcggccggggcgtgctgggccatgacccaacgcgcatcgccgctcttctgcagggtgtagtcgctggcatcggccaccgagcccaacggctgcggacgcggcacgatgtattcgcccttgacggtgtcgtcggccacgttgcgcggaatcggcagcagcggatcgaggcgcttggaggtgctgacatccgacggcagttgcatcggtgcggtctgttgcgcttgcaggtaatcgctgccgcggtcacggaagtagccttccggcccccaaatccaaccgcagccactggtgctggagataatcaaggcaagtgcggaaagtccggccaatcgcttcatgcgtagtacttcctcaattaaaccaatacgccggactggcgcatggcctgccgcagcggttcgtgacaggcagcactgagccaggtgagcggcagacggataccgttcgccatcaagcccatctcgcacagggcccatttcacgggaatagggttggattcgataaacagagtcttgttgagcggcatcagcttctcgtggatcgcccgagcggtggcggcatcgccacgcatcgcggcggcgcatatctcgctcatggcttttggcgccacgttggcggtcaccgaaatattgcccttgccgcccagcaggatcagttcgacggcggttgcatcgtcgccggagtacaccaggaagtcgctgctcacgccggccaggatgtccttggcgcgctgcaggtcaccggtggcttccttgatgccgatgatgttcggcacggtcgacaggcggatcacggtctcggcctgcatgtcgcaagcggtgcggcccggcacgttatagaggatctgcgggatatcgacggcttcggcgatggcacggaaatgctgatacaggccttcttgcgtcggcttgttgtaataaggggtcaccagcaggcacgcgtcggcaccggcgatcttcgcattggtggtcagctcgatcgcttcgcgcgtcgagttcgcgccggtaccggcgatcaccgggatacgccctgcaacctgagcgaccacgcgacgaatcacttcgatgtgttcgttcacatcgagggtagccgactcacctgtagtgccgaccgccacaatggcgttggtgccctcttgcaggtggaagtccaccagtttgctcaggctgtcccagtcgagacgaccctgtgcatccatgggtgtgaccagtgccaccatactgcccgcaatcatgcaaccgctcctgccggaaaaagagagcggtaatggtactggcgccaagatgcttgcacaagcgaagtaccgcgctgcgagcattcccctgagcgatgtatttcgctacccttcaggctttgatcggtactgctaagcttgtacgccgggttccagcctcccttttcggcatccgaagccccaatcctgcgttgccgcccttcgctctcgccttttatggagctcgtcgcaacctggcggttcagggcttctgaaaccgcatccggacgtttacccagtactcgagcctgcaaaagtatcgaccgctcatcgctttaggaatgctgcatgtccacccccacagtccgcgaacaattccttgtcatcagtgccctcggcgccaaccccatggagctgaccaacgtcctgtgccgcgccagccatgaaaaccgctgtgccgtggtgacctcccgcctgacccgccatggcgagtgcagtgcgctggtcctggaggtttccggcagctgggatgccctggcgcgcctggaggccggcctgccgtcgctggcgaagaaatatgccttcaccgtcaacgtagtgcgcagcgcggccctggaaaaccgcccgcaggccctgccttatgtggcttacgtcagcgctgcctaccgcccggacatcgtcaacgaactgtgccagttcttcatcgaccaccatgtcgagctggaaaacctgacctgcgatacctatcaggccccgcagaccggcggcaccatgctcaatgccacctttaccgtgaccttgccggccggcacccagatcagctggctgcgcgatcagttcctggacttcgccgacgcaatgaatctcgatgcgctgatcgaaccctggcgcccacagaacccaatgtaaggaagccccaatggccgttgccatcgaccaacctgttgcccacttcgaagccccggccaccagcggtcagaccgtcagcctggccgcgctcaagggcaagcaggtggtgatctacttctaccccaaggacagcaccccgggttgcaccaccgagggccagggatttcgtgatcaatacgccgcgttcaaggccgccaacaccgaggtgttcggcgtctcccgcgatggcctgaagtcccacgagaacttcaagtgcaagcaggaattccccttcgagctgatcagtgacaaggatgaagccgtctgccaactgttcgacgtgatcaagctgaagaagctctacggcaaggaatacatgggtgtcgatcgcagtaccttcctgatcgacaagaatggcgtgctgcgtcaggaatggcgtggcgtgaaagtgccaggccacgtggatgcggtactggctgccgcgcaggcgctgaacaaggcctgagcacggtaaccgactaaaaggtaaccgactaaaaaaaggggggcggctgattcagccgtcccccttttcatttccagaacagagccgctctagagcaagggcgccacgaccggctccttgcgcggccaggcatccagtaccgccttgaacagggtggccaggggaatcgcgaaaaacaccccccagaagccccacagcccgccaaacaacagtactgcacagatgatcgccaccggatgcaggttcactgcctcggagaacagcagcggcaccagcacgttgccgtccagggtctgaatgatcccgtagaccgccatcagatagatgaactggtcgctccacccccactgaaacaaggcaatcagcgccaccggcacggtcaccaccaccgccccgacgtagggcaccaccaccgaaatccccaccagcagcgccagcagggccgcgtagttcagccccagggccacgaaggcgatgtaggtcaccccgccgcaaatgacgatctcgatcaccttgccacgaatgtagttggcgatctgccggttcatttcctgggccacccgggtgatcagggcccgctcgcgcggcaggtaaccgcgcacccactggctgatcatcgcccgatccttgaggaagaaaaataccaggatcggcaccagcaccagatagatcatgatgttgaccagcagtggcagactggacagcgagaaggtcagcgcccactggccgaacttgccgatctcgccgcgcgccacctcgatcgcctgcaacacctgttcgtcggacaccaggtgcggataacgctccggcaacaacagaagcaacgattgccacttggcgagcattcccggcagctcgttgaacaaggtaatcaattgatgccacaacagcggcacgacgaccacgatgaacaccaacagcagccccatgaacaaggcgaagaccaggcccaccgccgccccgccaggcaaacgccagcgttccagcgtgagcaccagcccctgcatcagataggccagcaccatccccgccaacaccggcgcgagcatgccgcccagggtcagcaccgcagtgaaggccaggaacaacagaacggccagtaccacggcctcttcatcggagaagtagcgctgaatccagtcgcgtaacactttgaacatcaatgatccttagacagaggcgcgatgatttccggggcggttcaggccttcttcagccagtaacgatagaccccggcctcgtcttcctcgcgaagcaaggtatgaccggccaaacgggcaaaggtgcgaaagtcgcgctgggagccggcatccgtggcgatcaccttgagcaccgcgccgctggccaggcgattgagttccatcttggccttgagcagcggcagcgggcagttcagtccgctggcatcgagctcggcgtcgtgggctacagcatcagtcattgcgtcactccgggagggtcgtcgaagtgcctagaatatctggtccaaggcctggtgtccggctacagtagactctttgtcgactaaggctttgtgcatgacttttttgcgccctaccctgctgacgctcgcttgcctgctcgcctcaccaggcttcgccgacgacctgccatcactcggtgacgccagttctgccattgtctcgccccaacaggaacaccaactgggccgcgcctggctggcgttgctgcgcagccaggtttcgcaactcaacgacccgcaactcaaggattacgtcgaaaccagcgtctacaaactggtcgagaccagccaagtcaacgaccggcgtctcgagttcatcctgatcaacagcccgcagctcaacgcgtttgccgctcccggcgggattgtcggggtcaacggtggactgttcctcaacgcccagaccgaaggcgaatatgcctcggtgctggctcacgaattggcgcacttgtcgcaacgccacttcgcccgtggcgtcgaagcctcgcaacgcatgcaggtgccaatgatggctgccctgctggccgggatcgtgatcgccgcagcgggcggtggcgacgccgggatcgccgccattgccggcacccaggccgcggccatccaggaacaacggcgcttctcccggcagaacgagcaggaagccgaccgcatcggcatcctcaacctggaaaaagccggttatgacccgcgctccatgccgaccatgttcgaacgcctgatgcgccagtaccgtttcgacgccaagccgccggagttcctgctgactcacccggtcaccgaatcgcggatcgccgacacccgcaaccgcgccgaacaggccaaggccggcggcaaggaagacagcctgcgttaccagctgatccgcgcacgagtacaactgatctacgaagactcccccggcatgggcgccaagcgtttccgcgcccagctcgacgaaaacccgaaaaacgacatcgcccgctacggcctcgccatcgcccagatcaagggcagccagttcaacgatgcccgggacaacctcaagcaactgctggccaaacaacctaacgacatcacttacaacctggcccagatcgacctggataccgctaccagccgcttttccgacgcccaggcccgggtggataaaatgcttgcgcagtatccgggcaactacccactgaatcaggtccgggtcgacctgctgctcaagcagaatcgcccggcggacgccgaaaaggccctggaaagcctgctcaagacccgctccgacgatccggacgtctggtactcggtggcggaaacccgtggcctgtcgggcaatatcatcggcctgcatcaggcgcgggccgaatactttgccctggtcggcgactatcgccaggcgatccagcagctggatttcgccaaacgtcgcgctggcagcaacttccccctgtcttcacggatcgacgcacgtcagcgtgagctgatggaccaggagcaaatggtcaaggacatgatgcgctaagcccaatcggcgcccacaaaaaagcccgcctctttcgaggcgggctttttattgcgcgatcaatccgctacacgaattactcggccagcttgaaggtaatgaagctggcacgtccctgacgcagaacccgcatcgataccgaacggttcttcggcagcgcctgggcgatttcagtgaagttcttggtcgaagtgatcgcctgattgttcagatgagtgatcacgtcgcccggctgcaggccgatcagcgcggctggaccatcctgaacttccttgatcaccacaccgcccttgaggtcgtaggttttcttctgctcatcggtcagctcgaccaccgcaacgcccagacggttgctgctgcgctcgacaccggacttgccaatggcgtccagggccttgtcttcgtccggaatcgcaccaacggtcaattcgacgttcttgcgcttgccgtcacgaatcacttccaaattggctttcgcccccgccttgagggcaccgaccagatgcggcaggtccgccgacatgatgatcggttgaccattcatgctcaggatcacatcacccacctgcaagccgcccttggctgccggaccgtcgtcctggatctgcgccaccagcgcaccggccggcttctccaggccgaaggactccgccaggtctttgttcacttcctggataaccacgcccagccagccgcggctgactttgccaccggctttcagctggttggaaacgtccatggcgacatcgatcgggatagcgaaggacacacccatgaagccgccggaacgggtgtagatctgcgagttgatacccaccacttcaccggccaggttgaacagcggaccaccggagttacccgggttgatcggcacatcggtctggatgaacggcacgtagttttcgttcggcaggctacgaccgatggcgctgacgatgccctgggtcacggtgtggtcgaaaccaaacggcgagccgatggccactacccactggccagccttcaggtcctgggacttgcccagcttcagcaccggcaggtccttgccatcgatcttcagcaacgccacgtcggaacgcggatcggtgccgatcagcttggctttcaattcgctgcggtcggccaggcggacaaggatttcatccgcgtcggcaatcacatggttgttggtcaggatgtaaccgtccgacgaaatgatgaagccagaccccagggactgggcttcacgctggcgatcgccccgtggcgaacgcggctgcggcggcatgccacgctcgaaaaactcgcgcagcatcggcggcagaccttcgaggtccggcatctgggcggaaaccttgcggtccgggagcttttgcgtggtactgatgttgaccactgcaggcgacgcctgctcgaccagttgtgtgaagtcaggcaagtccgccgcctgcgcggtaacggcctgaccgagcaccaacacagtagcgaaaatggagagataggatttcaaacgtggtatcgacatacggctcccattacaacgagcgtggttaagcgatagggacaagaaataccaggcgactcgcgcagtacttttgtcccggaaacgacaaacaaggccagaacctagtggctctgacctataagaaaaaacagggggttttgcaaatgaaaatgttcaccgaacatttagatatctcgattgcagagctggcattgcagacctcttacacaaccaacattaacgctcgatgaacacctggggctgtactcactgcgccttgggcgcagcggcgtcggtacgcatcgacaaggcgatccgttcggcggtaccgataggtatctcacccaccaccgttaccatcatctcgccttcaggcgtggtcaggcgtcgggataccgccacggtcgggcccagttgagtgcgggtgtcggtcaccgtcgcaccattgagcggctcgaggaacaccgagaagcgggcaaggccatcgtcatacatcaggctgttgaccatggtcttggtgtcgggatctttacgcgcactgctgctggtcaactcgaagcctggcggcagccagtcggaatgccaggcctgcgcagccttcaccgcggaagccttgtcgctgtccagggccacggccttgcattcggcgctggcctgcagctcgctgtccttcggcacatccaccgtatccaggcgagtgaactggaagcgctcgagcaactgccccttatcgttcaacaacagcgatttcagcggcaggcccgtctcgcgatccagatgcaattcaaaaccataacggtgctggtcccgcggggtcagggaaacaatgaccgcggaacgcccagccacacgcgacttgccgatgacggcaaggtcgtaccaattcttgagcttttctggatcgagtgagtgggccgaagagctgggggcatcccccagtccagccaccagcgtaccgctgacacattgggtacgcccatcaacacgcacaacctcttgagcggaaccgtcgagctgaaccagtcgctcgcggacctggccatcctggacgcgatgccagatgttatgggtagaaaaactaccattacgctcgtagacgaaagtaccctgaaagctttgctgctgttcggcttgcccaagacgtttcaaccaatcctgagcttcgtcggcgtgggctggaacaatgaaccagccactgagcagaagcgagagtagagggatggcgcgcatgatcctccttaacggttttccaggctcgccgcacgagcgtaaggcagagcgctttcagtgcccttcaatgcagcttgttgagcatgctgacgcaggtagcttggcagacgctgatcgtgccagcctggctgaccttgcaatacgccgttggccatagggccagtggcttccgaactctcattgtagccggccaatacagctgggcctttcacttgaggagcggccagggttggctggttcgattgctgtgccagttcgacaccagcgatctcgtcctggttgtacaggcgaacacccgccaatacggcaacggtcaccgatgcggcaacagccaggcgacccaggctacgccatggaccacgagtggccttggccggtacggcttcgtcagccagcgcagcagaaacagccgcggcgatgtccagacgcggaagcagcaattccttgtgcatggccgcccgggcgatctggtaacgagcccaggtctcacgggtttccacttcgtcgacggcattcaatacccgacgtaattccagttcgtccgcttcgttatccatcaccgcggacagcgattcctgcagggcttcacgactcatggcggttcctctcttggctgtcgccgctgtctcaggtttcctgcaacaacggctgcagggctttatcgatggcttcccgagcgcggaaaatccgggagcgcacggtacccaccggacactgcatgacgctggcaatgtcctcgtaactcagaccatcgaattcacgtaaagttaaagccgtacgcaaatcttctggcagttgctgaatggttcgatggacggtgccttcgatctcatcccgcagcaatgcacgctccggcgattcgagatccttgaggccatgatcgccatcgtagaactccgcatcctcggaactgacatcgctatccggcggccggcggccgcgtgaaaccagatagtttttcgccgtgttgatggcgatacgatacagccacgtataaaacgcactgtcaccgcggaaattaccaagcgcacggtaagccttgataaaggcttcttgtgcaacatcctgggcttcatgggtgtcgtgcacaaaacgcacgatcaacccgagaattttgtgctggtatttcagcactagcagatcgaaagctcgcttgtcgccgcgctgaacgcgctcgaccagctgctgatcctcttcctgggttagcatgaacactcctcgataagctcggaggaggcttgcataactaaacgatcaggcttgcaaacatagactcgggcttttcgcaaaagttctccccctccaagcaagtttcctgcgggctctgatttggcacgcacgaaaaacgcagcgcgggcaaggccggctgcgcgaataatcctgtcgtcgaattgagttgcatgaccacaacacaagtcctgcataaaaaccgacgctgtcccttctatcaggcaaccttctattgagtttggggccgtatcaaaagttcccaatctttatagctgtgcagagcgaacattgtgtaaccatgaagagaaaaaggttgctacatcttcgatacagtcgccagctccccgatttgacggaaaaatcgagccacccatcactgcctcgcaagaccgcctttcccgcccccataatttcataatgccacgaaggcaccgctattgtgccgatccccccctctatatactagtgggctgcatggctgctttgactcgccgatccaggcgtcttgcgccaaccccgacccgggtcgcttttgagcggaatcttccaatgagccaacagtttcaacacgatgttctggtgataggcagcggcgctgccggtttgagccttgcgctgaccttgcctggtcatctgcgcattgccgtattgagcaagggcgatctcgccaatggctcgacctattgggctcagggtggcgtcgcggcagtgctggacgacaccgataccgtcgaatcccacgtcgacgacaccctcaatgccggtggcggcctgtgccatgaagacgccgtgcggtttaccgtcgaacacagccgcgaggcgatccagtggctgatcgaccagggcgtacccttcacccgtgacgagcaatcgggcaatgaagacggcggtttcgaattccacctgacccgcgaaggcggccacagccatcgccgcatcatccatgccgccgacgccaccggcgcggccatcttcactacattgctggagcaggcccggcaacgcccgaatatcgaactgctggaacagcgggtcgccgtcgatctgattaccgaaaagcgcctgggactggaaggcgatcgctgcctcggcgcctacgtactcaaccgcgccaccggcgaagtcgatacctacggtgcgcgctttgtcatccttgcttccggcggggccgccaaggtctacctctataccagcaaccccgatggggcctgtggcgatggcatcgccatggcctggcgttcgggctgccgggtggccaacctggagttcaaccagttccacccgacctgcctctaccatccgcaggccaagagtttcctgatcaccgaagccctgcgcggcgagggcgcgcacctgaagctgcccaacggcgaacgcttcatgccgcgtttcgacccgcgtgccgaactggcaccacgggatatcgtcgcccgggccatcgaccatgagatgaagcgcctgggtatcgattgcgtgtacctggacatcagccacaaaccggaagcctttatcaaaagccacttcccgaccgtgtacgagcgctgcctggagttctccatcgacatcaccaaacagccgatcccggtggtaccggccgcgcattacacctgcggcggggtgatggtcgaccagcagggccgcaccgacgttccgggcctgtatgccattggcgaaaccagctttaccggcctgcacggcgccaaccgcatggccagcaactcactgctggaatgcttcgtctatgcccgttccgcggcagccgacattctcgagcaactgccgcagatcgccattccgatcgccctgcccgcctgggacgccagccaggtcaccgactccgacgaagatgtgatcattgcgcacaactgggacgaactgcggcgattcatgtgggactatgttggcatcgtacgcaccaacaagcgcctgcaacgggctcagcaccgggtacgcctgctgctggacgaaatcgacgagttctacagcaactacaaggtcagccgcgacctgatcgagttgcgcaacctggcccaggtcgccgagctgatgattcgttcagccatggagcgcaaggaaagccgaggcctgcattacaccctcaactacccgaacctgctgcccgaggcactggacactattctggtgccgcccacctacggcgactgaacttgagccgcacgcgcaggcgccgatgcacatcggccgcctgcgcgtcccgcggcacacagaccgacctcacccagcgctcgcccggcaggcgaaaacgcaacaccaccagcagcggcagcgccaggctgtcaggccgcagctgcaccggccgccagccctgcccggcgcaccacaactgccagccatcggcattacgacgcagaccgctgaaagccgaggaatgattcagcagaatccgccgcggcaacgcccagactccgtggcccaggcacagcagaaccccgggcagacgggcccagagtgaaatatcgagcatcagcaaggcgcccagcgcgaacagctgggccaggagataggccgccagcaattgcctggaaggctgccagcggcattcgaaggcgttacttgggttggacacgatccaggatcatgcggaccatgcgttgcagctcgggatcttcggattcggagcgttccatgaaccagccgaacatgtcctgatcttcgcattcgagcagcctgacgtagcaggcacgatcaacatcgttcagatgcggatagacttctttcacgaatggcaccagcaacacatccagttccagcatgccgcgacggctgtgccagtagaggcgattcaattcaacatcttcgaccatggagcgctcctcaaatagagcgcaagtatacagcccgacggacaccagaacagtcggctttggtcggtcaccacccatcctttgtgaactacccatttcaagggcgcccccttatgatgttcgccagactttttaccctgcgatgacccatggctgattccgcttttttctgttccctgtcccacgagggcgttctcgccgtccgcggccccgatgccagcaagttccttcagggccagctgacctgcaatctcaattacctcagcgatagccaatccagcctgggcgcccgttgcacccagaaaggccgcatgcaatcgagctttcgcatcctgctcgaaggcgatggctgcctgctggccatggccaccgagttgctggagccgcaactggcggacctgaaaaaatacgccgtgttttccaaggccaagctcagcgatgaaagtgccctgtgggcgcgcttcggcctgggcaacgccgatacgctgctggccggtctcgggctggaactgccgccggaagacggcgcggtcgcccgcaacgacggcctgatcgccattcgtgtttcagcggatcggaccgagctctgggcccccgcagatcaagctgaggtcttgcgcgaacagctggccgcgcaactgcccgaaggcgacctcaatcaatggttgctgggccagatccgcgccggcatcggccaggtcatgccggccactcgtgagctgttcatcccccagatgctcaatctgcaggccatcggcggcgtcagtttcaagaaaggctgctataccggccaggaaatcgtcgcgcgcatgcagtacctgggcaaactcaagcgccgcctctaccgcctggccctgaacgccgaagagttgccggaacccggcaccccgctgttctccccgacccacggcagctccatcggtgaggtggtgatcgccgcgcgcgccgaacaaaacattgaactcctggccgtactgcaagccgaagctgcagaggatggcaatctccatcttggcgcgctcgaaggtcccgggctgcacctgctggacctgccttaccagctggatcgcgatcgagaaatccagcgctgattgccgcaacttcctgcaatacccctagagaacagaaatgagtgagctggcggaaaaggtccaacaggatttggttgaggccatcgacaacgatgacctggttctgccaacgctaccggaagtggccctgcagattcgccgggccgctgaagatccggaaatcagcgtcagtaccctgagcaaagtgattggccgtgatacggcgctgtcggcgcgtctgatcaaagtggtcaacagccccctgctgcgcgccacccaggaagtcaccgacctgcacaccgcgattacccggctgggggtcaattacagcagcaacctggccatcggcctggtcatggagcagattttccatgcccgctcggaggtgatcgcgcagaaaatgcacgacgtctggcgcaaaagcctggaagtggccggcgtcagttatgccctgtgccgcagccatacccagttgaagcccgaccaggccgccctcggcgggctggtgcaccagatcggcgtgctgccgatcctgacctatgcggaagatcactatgagctgctgtccgacccggtcagcctcaaccacgtgatcgagcacatccatccgttgctgggcgacaagctgctgcaggtctgggagtttccggaacagctggccaagctgccggggcagtacctggacttccagcgccagtccgcgcgcctggactacgtcgacctggtgcaggtcgccagcctgtattgccacaaggacaccgaccacccactggcgaagatcgatatcctcagcgtgccagccttcaaaaagctcgggatcgaccccgagaacaaagtgatgtgcagcgatctggccgagtcgcggtcaatgttctattgaatcaatgccctactgaatcaaggctctactgaacctgtaccacagcctctagcccgcgttaaaactcacccgcaccttcagccccgcctgcgcaccatcgtgcaggctgatctgcgccagatgggcacgacagatttcgccgacgatcgccaggcccaggccggagccggcgacatgggggttgcgccggtagaagcgctcgaatacccggtcgcggtcctccaggggaatccccgggccgtcgtcctccacctccagcaccgccggcgcactgacccgcaggatcacgtttccgcccggcctggtatgggccagggcattgtccaccaggttgctcagcagctcgttcaagagggttggctcgccgcgcagccacaccggctcatcggcttccagggccagggcgacaccccgggcgtgggccaagggcgccatagccatgcccaactcgcgggccagctggctgagatcgagcaattgcgcgccgccctcggcaatcgcccgggcgccgttttcgatccgcgccagggacaacagttgattagccagatgggtcaggcgatcggtgccctgcgcggcgctttccagggtattgcgccaggtctcaggttccgaagcccgcagccccagctccaggcgcgccttgagcgccgccaggggggtgcgcaattcatgggcggcgtcggcgatgaactgcgcctgacgctcgaactggccacgcagtcgctcggtgaagtgattgagcgcccgcaccagtggccacaactcgcgttgcacctcgaccagcggcaaaggccgcaagtcgtcgggctggcgctcctccaccgcgctgcgcagacgctccagcgggcgcaacgcggcgctgaccgcgaaccacaccagcagcaaagcccccatggccagcatgcccaggcgcaacagggtatcggccatcaggctgcgcgccatgcggacccgcgcctcgtcggtctccgccacgcgaatctccgccatgccgttcatgttcggctcgctgaccgccttgagcaggctcaccacacggacgttctgcccttgataggtggcatcgtagaaccgcgccagcgccggataatcgtcggtgcgcggcgtgcccggcggcggaccgggcaggttttcgtaaccggaaatcagcttctgatggatatcgttgacctggtaatagatccgcccggcactgtcataggcgaaggtatcgagggcgacatagggcacattggcgctcaggccgccgtcgcgctgggacaaaccggcggcgatggtccgggccgaggccagcaaagtccgatcgtaagccgtgtccgccgcctcgcggccgttccagtaggcactcaggccgctggccagcatcagcaccaccagcagcagcgcgaggttccacagcaggcgccagcgcaggctgctgggcctatgcatcgcgactttccagcaggtagccaagcccgcggaaggtgacgatggccaccggctggccgtcgagtttcttgcgcaagcgatggacatagatttcgatggcgtccgggctggcctcttcatccaggccgaacacctgggaagccagttgctccttgctcatgacccgtcccggccgggcgatcagcgcctcgagtaccgcctgctcgcgggaggtcagggtcagcagttcttcacccagggtaaagcgtcgggtatcgaggtcgtaggccagcactccgcagcgctgtacccgctcaccgccgagcacgctgcgccgcagcagggccttgacccgtgcttccagctcggtcagttcgaagggcttggccaagtagtcgtccgcccccaggttgaggccgtggacccggtccttgacatcgctgcgcgcggtcagcatcagcaccggcaggttcttgccccgggcacgcaggcgcgccagcacttcgaaaccatccagacgcggcaggcccacatcgaggatcgccatggcgtaatcctcgctgcccagggccaggtccgcggcgactccgtcgtgcagcacatccacggtcaaacccgtgctcttgagcgcctgggcgacactttcagccagctgcaggtggtcttcgacgagaagcacgcgcatggatttcctacctcgttcaggggatcgacggcactttttattgccgcggagtttacagccgagaccgctgctgtgaagcccgaaaaccgtgaaagtctgctgaaaggttagcgaaaggttggccctttagagtcctgtcacggattgtttcgacttccgtggctacccccggtggcctcccgaaaaacgcctcgaagcgttttcgccaataagaacaataacggagtacaacacgatgctgtccatgcagcctcaggcttgccagcctgttcgtttttcccgtctcagccacaccgccctcgccagcgccgccgcccttgccggtttctcaccgatcagccaggccgccttcttcgaagacagcagcgccaccctcgaaacccgcaacatgtacttcaaccgcgatttccgcagcggcaccagtgcccagcaatccaagcgcgacgaatgggcccagggcttcatgctcaatctgcaatcgggctacaccgacggcaccgtgggcttcggcgtcgatgcgctgggcatgctcggcatcaagctcgactccagccccgaccgcaccggcaccggcctgctgccgacccatgacgacgggcgcgccgccgacgagtacgccaaggtcggcctgaccggcaaagtgaaaatctccgccaccgaactgaagatcggcagcctgatcccggaactgccgaccatcaagcccaacgacgggcgcatcctgccgcagaccttcgagggcggcctgctgacctccagggaaatcaagaacctgaccttcaccggcggccgcctggagaaagccaaggatcgcgacagcaccgatttcgaggacatcgccctcaacaacaagaacagccgcttcgccggcaccgtcgccggcaagcacttcgacttcggcggcctggactacaagttcaccgacaagatcaccggcagctaccatttcgcccaactcgccgaggtctacaaccagcatttcttcggcctgctcgcctcgcagccgatgggcccgggcaccttcgccacggacctgcgcttcgccgtcagtgacgaccagggccaggctcgcggcggcaagatcgacaacaaatccctcaacggcctggtgagctacgccctgaacgggcataaactcagcgccggctaccagcacatgtccggcgacagcgccttcccctacctcgacggggccgacccgtacctggtcaacttcgtgcagatcaacgacttcgccggcgccgaagaacgctcctggcaagcccgctacgactacgacttcggcaagctcggcatccccggcctgaccttcatgacccgctacctgagcggcgacaatatcgctctgaaaaacggcgataccggcaaggaatgggaacgcaacaccgagatcaagtatgtggtgcaaagcggcaccttcaaggacgtcgcggtgcgcctgcgcaacgccacctaccgctccaactattcggcccgcgatgcggatgaagtgcgcctgctggtgagctacagcctggcgctctggtaatcgaccgaccttcggcaggcgccgcgcctgccaaggcccctggcatgcaacacacaacaacaactcctgtggagacaagcatgaatccatcactgcgtaaattggccctcgccgccggctgtatgctgttcgccggtcaactgctcgccgccagcgccgaacccaagcgcccggaatgcatcgccccggcctcccccggcggcggtttcgacctgacctgcaaactggcgcagagcgcgctggtcaacgaaaagctgctgaccaagccgatgcgcgtgacctacatgcccggcggtgtcggcgcggtggcctacaacgcggtggtggcccagcgtcccgccgatgccggcacgctggtggcctggtccagcggttcgctgctgaacctggcccagggcaagttcggccgcttcgatgaaagcgcggtgcgctggctggccgcggtcggcaccagctatggcgccatcgcggtgaagagcgactcgccgtacaagaccctcgacgacctggtcaaggcgctgaagaaagacccgagctcggtggtgatcggctccggcggcaccgtcggcagccaggactggatgcagaccgcgctgatcgccaaggccgccgggatcaacccgcgcgacctgcgctacgtggccctggaaggcggcggcgaaatcgccaccgcgctgctgggcgggcacatccaggtcggcagtactgacatttccgactccatgccgcacatccagagcggcgacatgcgcctgctcgcggtgttctccgacaagcgcctggacgagccggaaatgaaagacatcccgaccgccaaggagcagggctacgacatcgtctggccagtggtgcgcggcttctacctcgggccgaaggtcagcgacgaagactacgcctggtggaaagacgccttcgacaagctgctggcttccgaagagttcgccaagctgcgcgaccagcgcgagctcttcccgttcgccatgaccgggccggaactggacgcctacgtgaagaaacaggtggccgactacaagaccctggccaaagagttcggcctgatccagtaatcgcccctgtctagcggccctgcccctttcgcgggggcggggcccaggagtttcccatgctcttacaacgccttttcgcctcgctgctgctcctggtctgcctgggcctggcactgatggcctggccctaccaggccgccttttcctacgaaccggtcggcccgcgcgcctttcccctgctgatgctcggcctgatgggcctggcgctgctgtacatggtgtttcgcccggcgccgatcaagcacagcgaagacgagccgccactggaccgtgaaaccctgactaagatcagcatctgcgtggtcctgctgctgatcttcgccggcctgttcgaacccctgggtttcattctcagcagcatcctgatcggcattccgatggcgcgcctgtacggcggccgctgggtgcccagcgccgtggtcaccacgctgatggccatcggtctgtatgtgcttttcgatcgggtgatggacgtgccactgcccctgggcctgctcgacgttctggagaactgatatggatacgcttggctatttgggccagggtttcggcgtcgcgctgagcccctacaacctggtcaccgccctgaccgggaccctgatcggcaccgtggtcggcctgctcccgggcctgggcccgatcaacggcgtggcactgctgatcccgatcgccttcgccctcggcctgccaccggagtcggcgctgatcctgctggcggcggtatacctgggttgcgaatacggtggccggatcagttcgatcctgctgaacatcccgggcgaagcctccaccgtgatgaccaccctcgacggctacccgatggcacgccagggcctggccggcgtggctctgtcgctgtcggcctggagctcgttcatcggcgccttcatcgccacctgcggcatggtgatgttcgccccgctgctggcgaaatgggcgatcgccttcggcccggcggagtatttcgtgctgatggtgttcgccattgtctgcctcggcggcatggccggcgatcgtccgatcaagacctttatcgccgcgctgatcgggctgttcctgtcgtcggtcggcatcgacgccaacagcggcgtgtaccgtttcaccggcgataacatccacctcaccgacggcatccagttcgtggtgctggtactgggcctgttctccattagcgagatcctgttgctgctggaaaaaacccatcgcggccaggaagcggtgaaagccaccggacgcatgatgttcaacttcaaggaagcggcgtcggtgttcgtggtgaacatccgttgtggcctgctgggcttcatcatgggcgtcttgccgggtgccggcgcgaccctggccagcgccgtggcctacatgaccgaaaaacgcatcgccggcgccagcggcaagttcggccagggcgacaagcgcggcctggcggcaccggaaaccgcgatcggcgcctcggcctgcggcgccctggtaccgatgctgaccctcggcgtcccgggttcgggcaccactgcggtgatgatcggcgccctgtcgctgtacaacatcaccccgggcccgctgctgttccagcagcaaccggacatcgtctggggcctgatcgcctcgttgttcatcgccaacatcatgctggtggtcctcaacatcccgatgatccgcgtcttcacccgcatcctcgccgtgccgaactgggccctggtgccggtgatcgcaatcatcaccgggatcggcgtctacgcggtgcacgccaccaccttcgacctgttcctgatggtcggcatcggcatcttcggctacatcctgcgcaagctggacttcccgctgtcgccggtgctgctgggctttatcctcggcgggctgatggagcagaacctgcgtcgcgcgctgtcgatctccaacggcgcgatggaaatcctctggtccagcccgatcaccgtcggcgtctgggtgctgaccgtgatcatgctgctgatgccgctgctgcgcatctggcgcaagcgctcggccctgcaacgcgccgtggccgatgtctgaggccagcttcaaacagtggtggggtacgcccctggtcggtctggccggcggttacctcgccagccagatcggctggccgctgccgtggatggtcggctcgctgctggcgatcatcctggtgcactgcctgacgccctggcaactgggggaaattcccggcggccgcaaatgcgggcaatgggtagtgggcatcggcatcggcctgcacttcaccccggtggtgatggagcaggtcatgagccatttcggcctgatcttcttcggtgccctggtcaccagcctgtccagcgtggtcggggtctggctgctgcggcgcaccggtgaggaccgggccaccgccttcttctccagcatgccgggcggctccggcgagatggtcaacctcggcgcgcgcaacggcgcggtgctcagccgcgtggcggccgggcagagcctgcgggtgctggtggtggtcttgtgtgtaccggcggccttcaagtacctgctcggtgagggcgtgcctcaattgcatccggccagcgtcgattggcgctggctggccgtattgtttccggcgggcgccctgctcgcctggctctggcaacgcctgcgccagcccaacccctggttgttcgggccgctgctggtcagcgccgcggtcagtatcggatgggacctgcatatcggcctgccggacggcggcagccagatcggccagtggctgatcggcagcggcctgggctgtcacttcaatcgccagttcttccgccgcgcgccctcgttcatgggccgaaccctggtcggcacggcgctgaccatgctgatcgccagcctcgcggccgtggccctgagcgccttgactcatctggatttgcgttcgctgacgttgggcatgatgcccggcggcatcgcggaaatgagcctgacggccgagaccctgcaactgtcggtgccgctggtgacggcgatgcaggtgatgcgcttgctgttcgtgctgtttctggccgagccgctgttccggcattgggacaagaaaccggactgaagccggtcccctgtagccgctgccgcaggctgcgatcgacctcgaagggggcgcgatgttcagcgtcgccaaggtccttcggacctatcgcagcctgcggcagcggctacagggttttgcgttgagctctgtagcgaggcttgcccgcgatggcggccttcaaccccccatcaaaccggcggcaaccgccactcgatcggcgtctcgccattctgctcgaggtacttgttagtccggctgaaatgcccgcaaccgataaagccgcggtacgccgacaggggcgacggatgcaccgaagtcagcaccaggtgcttggtggcatcgatcagcttctgcttgccctgggcgtgggaaccccacagcaggaacaccaggtgcggctggtgctcgctcaccacttcgatgatccggtcggtgaaatgctgccagcccctgcccgcgtgggaagcggcgttggcccgttgcacggtcatggtggtgttgagcatcaacacaccctggtcggcccagctctgcaggtagccgtggttggccatgtcgatgttcaggtcgcgcttgagctctttatagatattcaccagggacggcggcgccggtacacccggctgcaccgagaagcacaggccgtgggcctggccggggccgtggtaaggatcctggccgaggatcaccaccttgaccttgtccagtggcgtggaattcagcgcattgaagatcagcgggcccggcgggtagatctccttgccagcggcatgttcctgacgcaggaactcgcgcaactccgccatgtaaggctggtcgaattcggcacgcagcgcctgcttccagctgggttcgagtttgatacggtcgtcatcggtcatggttgcacccggaaaaatcaatgggcgcaccctaggaaagcccaccacgcttgtcaattgatctgacgcagaaccgccactttcgcctatagcgatcatactgaacgctcaaattcccgatcgaggtcacgatgaatctgcacttcgaagaactcaccggcaccgatggcgcgcgcatcgcaattgccagcctggatgccgaacactccctcaacgccttgtccctgcccatgatccatctgttgagcgatcgcctggaagcctgggccaaggacccacaagtggtctgcgtgctgttgcgcggcaacggcgccaaggccttctgcgccggcggcgaagtgcgcagcctggtccaggcctgcctggcccaccccggcgaagtaccgccgctggccgcgcagttcttcgccgcggaataccgtctcgactaccgcctgcacacctacccgaaaccgctgatctgctggggccacggctatgtgctcggtggcggcatgggcctgctgcagggcgccagcatccgcatcgtcacgccaagcagccgcctggcgatgccggaaatcagcatcggcctgtacccggatgtcggcgccagttggttcctctcgcgcctgccgggcaagctcgggctgttcctcggcctgaccggcgcgcatatgaacggccgcgacgccatcgacctggacctggccgaccgcttcctgcgagacgaccagcaagaagcgctgatcaacgggctgctacagctcaactggcaggaacagacgccgatgcagctcaacagtctgctcaaggccctgcaacaggaggccgtcgaacaaatgcccgcagcccagtggcttccacggcgccaacagatcgacgagtggctggacgtcagcgatgtacgctgtgcctggcgagccatcagccagttgcacaatcactccgatgccctgctggcgcgggcggcgaaaaccctcagcgaaggctgcccgttgaccgcctgcctggtctgggagcagatccagcaggcccggcacctgtccctggcccaggtgttccagatggaatacaccctgagcctgaactgctgccggcatcccgaattcagtgaaggggtgcgggcgcgcctgatcgacaaggaccacaagccccgctggcactggccggacatcaacagcatccccgacgccgtggtcgaggcgcatttccacaaagcctgggaaggccgtcaccccttggcggatctgtcggacttctgaaaaccagccatgaaaaagcggcgctccaggcgccgcttgttggttgtgggcagatcagcggttgtgatggcggtcacggtggtgatcgtcgcgaccacgatcgctccagtcttgaccaccccgccggccgtcaaagtcacggcggccgtcatggcgccgatagtcgttgttccagccctggcggtggccgtcccagccacggttcgggtaggcgcgataaacggcccgcggtgccgattggtaataccgcggctggtagtaccggggcgctggttgatagtagcgaggcgcagattggtaataacgcggcgcgtaatagccgcggccggaagaataataggaaccgccgtagtagaccggcgccggcgtcgtatagacctcagagcggtagtaagtggaacctccgtcgtagtcgtaatagggaacgcaggcagaaagagccaaacccagaaacgcagtgagaagaattcgacgatacatggcggcctcctggaccgctgatgggccatgccagcgacgctggccggcggcagccaaggatgttctggctgacgagatatctgaccgcgaaaacggggtctggtgcgattttggttacaccttgatacaagtcgccaggcaaggattttggatccgaaaacggccggttttcgcgggctttacgccattgctggcgagcgatcaaatggcgcagctacccgtcggcgcggccactagaatgcttgcatcgggtcacggccacggagtcgtccatgccgcttagctccccgctgtattcgcaacgctggctgatcatcacgctcatcgcgctgctgggcggcggttttatggtcacctccttactcagctattacgcctcgcgaacctcgatccgcgacaacatcgtcaacactgagctgccgctgacctccgacaccgtgtattcggagatccagaaagacctggtacgaccgatcctgatctcttcgatgatgtcccgcgacaccttcatgcgcgactgggtgatggctggcgaacgcgatcccgagcagatgacccgctacctcaacgaggtgatgacccactacggcgcctacaccgccttcttcgtctccaacagcagcctgacctactaccacgccaagggcgtgctgaaaaaaatagcccctgataccccccgcgacgcctggtatttccgggtccgcgacatggccaccccgtatgaaatcaacgtcgatccggaccaggccaaccagaacaacctgacgtttttcatcaactacaaggtctacgactaccaggacaatttcatcggcgccgcgggtgtcggcctgaaggtcgatgcggtgatcaagctgatcgaccgctaccagcagcgttatcagcgcagcgtgtatttcgtcgatacccagggccggatcgtcctcaccggggccgaaggcggcccccagggcgctcgggccggccagtcgctgttcgaactggaaaacctgcgcgacctgcgggccaggctgcccaagccccatagcggcaactacgagtacagcgccccagaccagcggcacttcctcaatgtgcgtttcattcccgagctgaactggtacctgttcgtcgacaagcgcgaggacagcgccctgggcgatatccgccgctcgctgtacctcaacctgctgatctgcctggcgatcaccctgatggtgctgaccctgctcaacggcgtggtcagacgtttccagcgcaagatcgaaacccaggccaccctcgacagcctcaccggcctgcccaaccgccgcggcttcgacttgctggccgcccaggccatgctcgaagcccagcgcgagcccaagccgctgaccgccctgctgctcgacctggaccacttcaaacgcctcaacgacacctacggccacctcgccggcgaccaggtgttgagcggcttcgcccggcacctggcaagctgcctgcgccagtccgatatcgtttgccgttggggcggcgaagagttcatcgtgctgctcaaggacaccgacagcgccacggcgctgaagatcgccgagaagatccgcctgctgatcgagcaacagcgctatacctaccagggcaagaatatgcggctgaccgtcagcatcggcgtgaccacactgcaggcggacgataccctgcacagcctgctgtcacgcgccgaccatgcgatgtaccgtgccaaacagaccggccgcaaccgaacctgcgtggaaatgcctcactcccgttatgaatgaaccgaccctgaacagccccagccccagcctctgcccagcctgcggcgcccgcaacgactgcagcctggccgacccgcgtaccgccgaccaggcctgctggtgctacagcgtgagcatcgacccggcggtgctcgaagccctgccacccgagctgcgcgatcgcgcctgcctgtgcccgcgctgtgcccgggtcgacgcgcaactgcaagcggccgcccggccgatcccgtaagatgcgcagccttttgccagcctgccgatagccatgcgcgttgatcgcttcctcagcaacctgccccgcttcaaccgccagcaggtgcgcctgctgctggtggcaaagcgcatccgtatcgacggccaggtggtcagcgatccccatgccgaggtgcgcgagttcagccgggtcgagctcgacgacgaagtgctgcaggccggcaagccgccgcgttatttcatgctgcacaaacccatgggctgcgtcagcgccacccgcgatcccgaacaccgcaccgtgctcgacctgctggacgaaccggacaagcacgaactgcacattgccgggcgcctggactacaacaccaccggtttgctgatcctcaccaacgacggcagctggtcgcggcgcctgacccagccgcagaccaagctgccgaagcgctactacgtcgagaccgaacaggacataggcccggagtacgccgagaccttcgcccggggcctgtacttcgctttcgaggacctcaccaccctgcccgccgagctgcagatcctcggtccccggtgcgcgcggctgagcatcgtcgaaggccgctaccaccaggtcaaacgcatgttcggccatttcgacaacaaggtcttgcgcctgcaccgcgaacgcatgggaccgctggccctcgacgaaaaactggtgcccggagagtaccggccgctgaccgatgaagaaatccgcctggtctgagcgtctacaatttccgtagccgctgtaagccatcgacgatgcgatgaccattcagccgaagttgtcgaacaatttaccaacggcacttgcgagacggcgttctccctgcttgaatcagtccgtcggccgaaatgtgaccgatgagtcacgaacatacttctaagaaatcctttgccgtccgagccgcctgtgctcaccccgcattccggcaaattgcccgcttataacaacacccgtcgaccatctgttacggatcgacatgggctaaaaaattccaggcgtatgcctacctgtcacaaatctcgtgcaccctcggttgcgcgcatacccgcttgccaggagtcttatgacatgaggccagaaatcgctgtgctggatatacaaggtcagtatcgggtttacacggagttctatcgcgcagatgccgcagaaaagaccatcattctggtcaacggctcaatggccaccactgcgtcttttgcgcagaccgtgaagaacctgtatccgcaattcaatgtagtgctctacgaccagccctacgccggccgttcgaaagcccacaacaaacacgagaaaatgctcaccaaggaagtcgaggggctgatcctgctggagctgatcgaccacttcgccgccgagcacgtgatgtcgttctcctggggtggcgcgccgacgctgctcgccctggcacaacgcccgcggcgcattgaaaaggcggtgatcagctcgttctcgccggtgatcaacgagccgatgcgcgactacctcgaacgcggtgtcgattacctcggcagccgggacggcggccgtgtcgggcacctggtcaacgagaccatcggcaagcacctgccgtcactgttcaagcgtttcaactatcgacatgtcagcaccctggccgagcatgaatacgggcagatgcacttccacatcagccatatcctcaacagcgaccgccagtgctacctgaaagcggcgaagaacatcgaggtaccgatgctgttcatgaacggtgaatgggacgaatacaccgccgccaatgacgcccggctgttcggcaaccatgtccggcactcgacgttcagcaccatccaggccgccgggcacttcctcgacatggaacacaaggccgcctgccgggacagccgtaacgcgctgatggggttcctcaaaccgacccagcacaccagtcgtccgcgctatcactacctgcaggaccaccatgccctggctatctgaagtggcgtcatcgcgagcaactcgtcccctacccctggagcgagcttgcccgcgatagaccgcaagccggtcttcgccccgtcgccgcgatgacggcgtagaggcgtgcctgcgtgcatctcccgccgcttcgcaaacacaggtccggcaaagaaaaacttcaaatccgcgcgcacttctggtacaaagtcagccgctccgagcgggtgtcgtataatggcattactccagcttcccaagctgataacgagggttcttataggacaccccgttttgtgagcaaagaaatatgtgtaatgcgggtatagtttagtggcaaaacgaaagcttcccaagctttagttgagggttcgattccctctacccgctccaccctccccctcttttcccccagtaaataagcctcttggcctctcttgtcagtccattcttctaccccccgctctgctcactcactttctaaacaccactgatctaccattgagcaatcgtcacggatcacattgtgttgtgaataaaggaagcttctagagagggagcaaacgagctagcgctgtgcaccccagactttgctcaccaaacctacacgccaggtcagatgagaaggaacctgcaggtaggcactgagaacaaaggaggttcagccacgcacctggcaacggacacgtcgcacaacctcgcaggcagccttcgcccccctcccctatgggactcccaattttcggttgacccatggggaataggtaattttggtaatctctttttctgactcctgaaaacctcaatagaatcaatgagttgtaagatttctataaaggtaataatagagtaatgaatgggttagaaaattactgtccagctcagtaataccaggccccaagaaaaccctgtaaaatcaggcacttgaaagaaaattacctcctgccttaccaataattaccttttgaagtaatgagccaaagccccgaattgcaagggctccaggccatatctcgacctcgcttaccaaaattacctttttcccgcgcctatcctgaaaaatagcctgtgctcgttcccgttttgacttttttcagcctccacaaatcgccgctcgaatgcgcctcatcgcaggtcaatctgtgcaatcgaccacctgactggaaagcccgacgcgccggggctttcgctcacatcgataccgttcctggatcactccaaaagttcaccaggtgcgaaccagccaaaagtgaaaacgcaacaaaacacctgttttcaaacgcccagcccctgtaaatcgcggcctccagaactccgcccctgctctggcttgtcctgagcgcagtgcaaagccgctgcacttttttgcaaaaccttgcaccctctgcaatcgccaaacgccccacagaccccgcagcgggcctgggcgggagcatcgtttacaccgccaaccgcctttgcacaaataagcgacgcaaagcccgccggcgggagggggataagtgctttttctgcagattctttctcggcgccggaattttcccagggcatcgtgctgttctcctgatcgtcagttcatcaggactgaaccccggcagggcgccggtactggctgcggctccagaaaaaagcccccagagctgtgcagctgtgggggcgttcttgggagggactattccgcgataggtgaccgatcaggatttactgctcagctcaatgtttaggtctcgttctcattccactgaagttcttgggccatacgaactgaaagcgacgccgattcgctggatcaataagttcattcgcacccaacgattttttaatcgactgccgtttttttgaaagtacatatgacgaagtagccgtaaagcataaggctacctcagccccccttagggacttccttacagaaagtgaaggttcgacctgcttaatcttggatgagctggtgcaagcatcagttacatagatgcttcaggccaattgatttgctcaatttgctggagacccaatatgcactcacgccgttattccagtacgaacctgccgcactcatccggtttcacctcgtgttgtctggcccctttgtcggtcagaggtattgctgcgcgccatcagcaggattcgtatgctggctaccttcctctgtcggccaatatcgtactaacccaggtggtaaatccgcgcgtggcgccatcttgctatcggggtcgttgcgcagcgacggcccggtttcattgctttaccccaaaagctatcggggagaactcagcctcgcgctggaaattgagggatggcaggaaacgccatgaggggccagccctgactgttttttgcctcgcgtgagcagtcagaagtggcgcttgattagcgtcacaacccacgctgtgccgaatgagcaaacactactgatatcaggagcagcaaaatgaacatgaaccaatctctgctggtagctgccttggctgcagcaacttttgggggaacctccagcgccatggcgctgaccttcaccgatggcggcttcaccggcagcgtcgacatcagcggtaccgtcgacgtccccgtggccactaaccaatggcaatgggctgccggcgatgccatcagcttcgcttccatcccggtcacccagatgaccaatagctataaaaccctgaccctgcccgcgaccgccaacctgccgctgctggtgggacagaccaaggcggcgactattggtaatgcaggaaacgtaggtatcaacccacagattgccttcacggatgcggccggtgccaccgtgaccccggtgtgggagaacaccgacaacaccggtaaaggcaccatcaccctgccggtgactgcagcggatggcaccaccgccctgggcaacatgaccatgacggtgaaagtcggagccgtaagagcggtagtgacgacggtaaataactttttagagtcaacacatactacaaacactggtgtggagctgtatggtggagttgctcagccttccgcggcagctggggccttggcgacaggttcgatctccgcaacatggaatgctgctctgggtgccaagactgatacagatctacgtgatcaactgaatactgctagcggcttaagtttgactacatggggtagtgatagttcaaccgcagcatttgggtttaatgcacctagcgagtactattctggcacttacggcctcggcatcgcccaaggcgataacatcaccgtgcacttcaccaaccctgttaccgtcaataccacctggaaagcgccgctgaaaatgacggtgacttacctctaatcgcgcaacgaactgaaaaaatcaaataaagatagccaacgaaatcgcggagttttttgcaaaaaatggagcgaactatcttttacttaagctaagggagttgtccatgaaaacgaataaactttatatggcagtggccgcagtcgccttagggctctcctcccacgccatggcgctgaccttcaccgatggcaacttgaccggtggtgtggacatcggcggcgatatcgcggtgccggtcgctaccaaccaatggcaatgggctgccggcgatgccatcagtttcccttccatccacgtcacccagatgaccaatagctataaaaccctgaccctgcccgcgaccgccaacctgccgctgctggtgggacagaccaaggcggcgactattggtaatgcaggaaacgcaggtatcaacccacagattgccttcacggatgcggccggtgccaccgtgaccccggtgtgggagaacaccggcaacaccggtaaaggcaccatcaccctgccggtgactgcagcggatggcaccaccgccctgggcaacatgaccatgacggtgaaagtcggagccctaagagcaggaatagaaattgctagtacaacagcgacgcttctagactcaatgtatactggaacagctactcagcagttttatgggcagttcgcacagccttcaacagcggcgggggttttgtccaacggttcgagcgcagcagcatggaatgctgttcttggggcccactctgctacagatctgcttgctcaactgaatactgctaagggctccaataatactgcgtggagatttgattcatcaggtgccgcattgggttttaatacccctgcttggtacttttctggcacttacggcctcggcatcgcccaaggcgacgacattgtcgtgaacttcactaatccggtcaccgtcaccactgcgtggaaatccgcgctgaaggcaaccgttacgtatctctaaataggtgacttacctctaaggatggtctgaagtagccccatgctttatggctacttcagcgtttcctccctcgccgaatcgctgtagccgaaccagttctgcatcaggtataggcgcagcatcgccattaacggataagccggccgaccgctttcgcccttcgggttatggagggcgatcaacgcaaacaaacttttcgaagaaactacccgcttcatctcaatcaggaacagtactttgcgggtctgcttgcgtttaccggcgtactcggcatcggcgaaggttatttgcctcatcggaaaatcggcgagtcgcgtcccggcattttgtcatattcaggaagttttcttccctaaagcgtgattggtttgagcttggccgcgagccctgcagcttttgcggcatccgcagcaaacgccgcggcgttgcccggcggcggtgtcggcccatgggtgtggccagcgagctgggtgttcatttcttgcaccaggtcgagcaagtcgcccaggatctgcagtacattgacagattctgaccccaaccaggtcttgggcgcctgcaggcgctggctaaccgccgccacactacggcgcaggccctggatctgctcctgcatgtcgccgccgaccgtggcgttgagcttctgccccaccaccaggttcaagtcgcggccggtagcctggtgcagatcatccacggccgccaggcttgcagatccgcccgacagcagcttgagcgcgcccagggcctcgatcgtcttcacccctcccacggactcggtcgaatggtcgtcgatcgtctgcgcgtggctctggaattgctcgcggttctccagggcctccacctcgcgctcgatcgccttgtcctggatcttgccatcggtttggcgcagccagttgccatcggcgtcgacgcgctgctgtaccgcctcgctctgctgccagacctggtgcccctggggcaccttcggcaggctcaggccgtgcggcaagatcgattgaatgtagggcttgtccggtaggccataggcgaagcacaccaccacccgcgtaccttcctccggaaaggcatagaggcccatttcctcgccgccggtcggcagcggcagtggaacaccagagaggatcggcagttgcggatctggctcgtcgtccgggcccaggacttcaatatccacggcatagcgcggacgaaagtcgtcgcagatcccagcgtctgcaggtgcatcggccacggcgataacccgggcgaagcgcggcagatggtagccgccggtaagttcgggaaattgccgctctacgctgcggcggattgcgtcttccatcggatggccatctggtcattggcaagggccacgctcgtgacgcgctcgccgttgttgatcgttgcgcctggccgcaacccgggaagggctgcaatcatcgcgctctggttgccctggtagccgtcgaacagctccgtggggatctgcagcggcggccgagtgccgaagaagctgtcagcccaactgcccacgaacacctctccattgccctgctgctgccaggtgaagtcggggatcccgaacacgcgggccaggctgtccatcgcctggtagccggcggccaggctgtagaaatacggcgccttgacgctgctgtacggccgatcagggacgcgaaagcgcaggccggtctgctcgctgacctcggccagcacggcgcgcaggtcgacgtgacgtaggttcagcggcagggggttggccagcacagcggccagctccctacagaacagcacctgctccaccgcgttggcggcggtgcagcgttcgacgtagccgatgaagtgccgctgcagcgtgccctcgttgtagccgatatccagcgtcaccaggcctttcagcggcactgcggattgcaccgtgaagttcgcccgtcccgggctggtggcgtccagccggacgtcctccttgaccaggacgatcggcgcgccattgatagccagtaccttgtgcagcttcacgtctgttcactcccgcccagccacttgtccacgcggcccagcaccttttcaaacccgctcagcgtcgggttgtcgctcgttgagtcaccaccgccaccttcaccaaccgggctacctggtgcgccctgggcgttgacctggttgctggcgcgtcgaccctcgaccttttccgggttcgattcgcgctcgctcagcgtgaactggaccaaccaggctttcagggtgtctgcctcgcgggcgctgacgccctcggaaaactccacctgtcgcacgccgaaggcctcggccgtgtcgttgacgatccggtacaggtgcagctggccaccgccggccgtggcttcggccaggcgcatcaggtcggtcagttgcaccctgtccacaaaggggatcatcagcgagacggccagggtcttgggcttgaagcccttgtgggccttgtcggtgttgcttgtctggcctgacatgtcgccgctttcaatgcgtaggtttgcggtgaccttgaggttcttcccctggactttttgcccatcgagcagcagcgtcataggcccaccagctcctgtacgaaactcaagccttccttggtgccgaccagtagcaggcccgcgcattgcacccattcatggcccggggcgtcaccagccagcagttggcggcgcagctcgctggtgttgcccggaccgatcaagcgcgcccgcatactaacgtcaggggttcccccggccagcaaggttttcaggtcggctagctgctgatcgcggccctgctgttgggtactcttacgcgcagccagcgcggccagatcgcccaacggcgaactgtcggcggcgtagccctccagcactgccagctggcccgtcatggattgcttggcggccttgattacggtgcagcgctccagcggcaacgcctgccagcgcggcagcggccccgcgacggggatctcccacttttcgctctccagcctcaccagatgctgggcccggcgctcggttcgcaccaggtcaggcagcggcagcaaggcattgaaccgcgacaagctgctggccaactgctcaaggcgcgtgcccaggaacagtatcgacagagcatattgctccccggccgggcgcctggtatcgctgaagtcctccaactttttggccaggtgttccaggacgttcggcgctgacaagaagcgctggtagcccgtgccgtgaccaatgccgctctgaaacggcgtcaccaccaggcacgccggcacctggcccaactgttcggccagcgctgcccggcctgcagcaaccgcgcctttggccgcgtcaccgacgggccccgggctggtgctggccaggccttccagtccggccaggcgttgggcggtgctgaccagctcgccgctggccaagtccttggccgccgccaggccgtccatccattgcgtggcctgctccggccagcgcatcgtcaccggcgcccaggtcatgccggcggcgtccaggtaacggctttcatggccttgaggtctttgtctttcagggccttggccacggcctgacggagcgtttcggcgtgctgcagcgcggcctgcctgaaacgcaccaggtcaaggccgattttctgcagttgggcgatggtgtgcggtcgcaacgccatgacctggtcggcgtcgtagcagggataaacgtcgtccagccccaacagcacctggccattgagattcacctggtcatcgatcgcgctgccgtagcggtacgtttcgcccagggcgttcgagttgaagccgccggcgatatacgtgctgtagtcggcgccgatcgcctgcagctttttctcctgcagggcggccagcacggcgtcgatatcgtccacccattcgccgtccttccagacctgaatcgccccggcttttgtggaggccgtttcgtttaagtcaggccgccatggcctgacctgcttgttgctggtgaaagtttgcctcagcctccgcgggcgggatatatccgattgagctcagcaggcgttggtggttgtaccagtgcacccatttcaaagtcgccatctcaacagcttcgcggctcttccatgattgacggtaaatcagctcggccttgtacagcccgttgatggtttcggccaaggcattgtcgtagctgtcacccttgctgccaaccgagggctcaatgccgcctctgccagccgctcggtgtagcgaatagagacgtactggctgccacggtcgctgtgatgaatcagtccatcggcacggtgtggctggcgggcatacagggcttgctccagggcatccagtacgaagtcggtcttcatgctggtactgactcgccagccgacgatgcgccgcgcaaagacgtcaatcacgaacgccacgtacagccacccttgccaggtcgagacataggtaaagtccgagacccagagctggttcggacggtcggcatggaactggcgttgaacacgatccagtggacacagcgatttgtcgctggccaccgtcgtccgcacaacctgtccgcgccttataccctgcaatcccgcctgccgcattagccgctccaccgtgcatctggcgatcccaatgccctctcgctgtagctgcttccagaccttcaccgcgccatagcactgcatgttggtatcccatacacgctggtgatctccagactcaacacctcatcgcgttgagcacggcaacaacgcaagtcagggttacgtagttgggccgcatgcctgcggtaaccggacggggcgatctgcaaaacacggcagatcgactcgaccccgagacggtcacggtactggtcgacaaaggccctcaggacttggtacggcggtcgagttccgcctgggcaaaatacgcactggccagacgcaggatctcgttggctttgcgcagttcgcggttctcacgctccagagccttgatgcgctcgcgctcttcggtggtcggccccggacgctgaccggcatcggttggatgacggcgaatccagccatgcaacgtttgcgctgcacagccgatcttcggggcaatggcctcaatggccgcccactcggacgggtagtcgttcaggtgctccagaaccatgcgcacggcacgttcacggacttcaggggaataggtcgtagtctttctcatggcctcatcttctcaagagttgaggcctccacgaaacccggggcgattcagcttgaatattgagtgatcgtgatgatcaccaccccgtctgccgatcataattcaggtcaacaccatttccgctcacctgatagggaattcggtccccctttggtaactgctgttgacaggatagggaacggctgcacatgaacgccagaggcactcgacagttgtcgagtttacgtttttataagcatcatcaaatatcaagcaacagtatgatttctaagaaagcgtatcaaatttgcttttgaggcttgcctcgcttcatgaagtcgcagtagctttaaatgacgccgaacgcatcacagcgcgcaggcaacattcaagagccacatgcaacaagtcaattttgaaattaagcaaattactgccaaaaaaagccaaaactgttgccgacggctaaagcgttaccttggacaatcttatgatttattccaatccccgctggacactcagcaaaaatactgctcaaaataaagagaagcgctgctgatagcttgcaattccgtaaataaggccagacgaggcggttaacttcccgacggcttatgcagtcaagcaaaaacctaatgcacgagacgatgtataggctcatgtgttaaacattcgttaatagctatcaagcctctactctgcattttcgctcaaacatagcaatgacgtagctctaaatggcactgagcgcaatttgcgcacagacaaaaacctttaggagattcatgtacaacccgttgaaacaataacatcttgcgcggcaccagtgagaagggcggatgtgtagtgcctggcacgctggcttatcggaaaattgcccacatcgattctgtacgctccagtcattgcggctggttgcaggaaggtaacatgcacaccccacaggaatagtcttttttaatttcgccatcaaatacttgcactcattatcaaaacactacgaaacatgtcgattgcgcataggtttctcgagaggcagaatgaatattgatatcttgatttttttcatgactgttagcatctctcatgtatcggtggctttctaaattaaatgaatacacacatgagcgcggcctgtaagaaacagccagaatcttctttaacatgtgatgagccccctgccaagggagcgaatttatttgaactggcgaaactactcccattgctgtccgttatgtgccgtattaacagttgggaagaggccaatctgcctacaccgcccacactcgcgggcaaggatctctttgtacggatagccgcaaatagcgttggtcaagagatgcagtcgcttaaggttctctattgggacagcaatcatgcctctagcggaatgcgcaaaagcatacgacagctagaacaagaaggatggctacggcgtgtgccatcgtccgaggatatgcgtcgtcgagttttggtagctactgaaaaacttcaagtgttggtagcggattacttgcgtgtactttcagatcacgtcatggaggcctcttcagttttacaacgtattaattcgagtctaccccagcaacgtttgccagccgctggaaaatcttaatcgttggagacaagctagatattcatgaggccacccgctttgccgcatcgaatttcagtttcgagggtcggaaattagtttttcatgcctacaacaaacccgaagccatgagattgcttaaaagaaccccagatagggtgatagtgctgactgacgccatcagcgatggtggaggatgcgacgctgcggacagtacgacacatacgcgatgttcttgagaatgcgtttgtaaggttgttcttcagacgagagcactcgatcacgacatccgaccaagtgaacgtgcaggttaatgacgctcatgaaattagaatgaacaaccgattccttccaaaatatccacactcgtttttttgtaagtccccttcgctctcatagtaaaaaacatcaaaaactaacgcgtcgcgatgcctggcaagcttgcttggattaggtagggagcggtgatgcgcctcattatcaacattcacgcaattttctcaaaccctatttgacaagctatcggaactgctcaatgtattggcgcgcgcggtcaatatagtagtttttaggcgcgctcctactaagcgacattaatacactgacagtctatgtactccctaatttcttcaatcaaggtggttgagaaggcgttgctattcgcattgcttccgtgcacaccagcaagtttttatccttatgctcgcccttaacagagcgttatccctcgcaactttgagtatctcaatttattccatgaccaggctacggccaggttggatgcttgggtgttacagcaactataatgtaaatcgtcccgatatttctggactctcttaacccgcccggctttccagatactcttgcagcttgttttacgcctcgacaccaactacgcggccacgtgcgggtgtaatgcgctggaacaacctgattgttgggagcgatgggatcttcagagtgaatggggcaaccttccgtagcttcccaaaggcgagtagtcatgacgacttggccctgttcagagcagtgttacaccaacgtcgtaccggatgccgatacacatggaacggtatggatcagtgaaaggtgaagtcgagcggcaattagaccggctacaaagagccgggccacaaggtgattcgcagttatttgcagctaatgtatgcaaggggagccgctgatctataccaatataggttgagcgcttccacagaccttcgactggtcgagacgatctctacaccgctcaagtttttcagcaacccaatgaacgccatcggcaagccgcgagcataggctcacggctgccgaggcctcgttacagagaaacgtaatgcatcagccgctgatcaccaccccagtggtgctgtggatatccgtcaccacctgcgccagatcagagttaatgacgttcaagccgctctccagttgaatgtgcaccttcgccctatcatccctagcgcttcctcccgcgccccctacatactcaagtggcacaccatgaccatcgccggccgcgaaggtcgacgcgctcatgtcattctggggcgcgctattgtcctgctggtcgatgtacagcagatcgttttggccaaagccggtcaggagcacattcaggtcgccatcgatgctcacaccgtcaccggacagcgtgttgcccgcagccggatcatctccagacagatccttgaccacaaaggcgtaatcgccattgccggcggagatgctcacctcagacccggtgaagcggccattgcccgtaatgtcgacccagcgctggctgtcgaccaaggcaccgttctcgtcgaacttctgtgccaggacaccgccatcgttggcctccgtagcgttgtatacacctgggttgacggtggcgaagtgtgctccgttgaaggcatcgctgacctgccccccggcagtctggaacatcccggcagcggtttcaatgtgatacttgttgcccaggtccagatcgaacgttggattgaggacaatactcttgccgtcagcgctcacgctcacgtggccaccactcaggtcagtaatgaccccattggcgacactgaacgtcaaggactggctattgtccttggcttcgccacgataaccggcgtggctcgcatcgttggcgtcattgaccagcttgatggtccaggtgccgtcggccaaatgccctgcaaggctcgacttgagcacgatgtccgagcgcacgtcaaagttgctggcaccatttacatcactgctgagcaccggattcaacccgacactcaccgcgtgggtctgcgtggcagaaacgttaccggcggcatcggtggcggtagcggtgatggcgtgcgccccgttacccggcacttctgcgctggtaaaggtggtcgaccaggtgccatcagtaccggctgtcacgctatggctgactttgtcccacacgacatcgaccttgctgtccgcctcggcggtaccgctggcggtgacacctgcagcctgctcggcggccgagacgacatcgtcgcccgccacggtggcgatcgttggcacaggcacgaccgtatcgaccttgaccgcatgagtaccggcggtagaaacgttaccggccacatcggtggcgaccgcactgatcgaggtgttgccatcggccggaatgtcggcctgggcaaaggtcgaggaccacttgccatcgacatcggctttcacggtatgttcggcggcgccccacacgaccttcacggagctgccgacctcggcagtaccgttcacgttcaccccggcggtcttctcggtggcattgacgatgtcgtcggtggcgaccgcattgatcactggcagcgatacgcccgtgtcgaccttgaccgcatgggtcgcggcggtagagacgttgccggccccatcggtggcgaccgcactgatcgaggtgctgccgtctgccggaatttcagtcgcagtgaagttcgaggaccacttgccatcggcagcagcggtcacggtgtgcacggtgctaccccacgtgaccttcacggcgctgccagccccggcagtaccggtcacgttcaccccggcggacttctctgcagcattgacgatgtcgtcggtggcgaccgcattgatcactggcagcgatacatcgaccttgaccgcatgggtcgcggcggtagagacgttgccggccccatcggtggcgaccgcactgatcgaggtgttgccgtctgccggaatctcagtaccggtgaaggtcgagatccacgcgccatgggcatcggcggtcacggtgtgcgcggcgctaccccacgtgaccttcacggagctgccggcctcggcagtaccggtcacattcaccccagccttcttctcggcaccatcgaccacattatcgccagccactgtagcgatcgtcggtaaggtcacggccgtgtccaccgtgacagcacggagacccaccgtagagacgttacctgcctgatctgtggcgatcgcgctgattgtggtgttgccgtctgccggtatctcagtaccagtgaaggtcgagatccacgcgccatggtcgtcggctgtcacggagtgctcggcgctaccccacgtgaccttcacggagctactaggctcggcggtaccgcttacggtcaccccggcggtcttctcggtggcattgacgatgttgtcgccagccacggtggcgatcgttggcacagccactgtcgtgtccaccgtgacagcacgggtacccgccgtagagacgttacctgcccgatctgtggcgatcgcgatgattgtggtgttgccatctgccgggacttcagtgccggaaaaggtcgtcgaccacttgccatcggccgcgacattgacagtcttgtcgaccgccccccacgccacttttacagtgtctcccgcttgagcagtaccactcaccgagacaccggaggttttatcaacattgttgaccaccttgtcccttgcaaccgaatcgatcatcggtacagcgacgcccatcgccgcctgagtgccaccaccaccaccaccaccaccaccaccaccaccaccaccaccaccacccgacagcaacgcaacgcctgcgacaagcgccccggcagtcaggccaatcgctgcccagtctgggctatcgccatccataaaaagcccggcaaggccagatctatcgtgctgctcatctgtatccgcggcttcctgtccggacgaagatgctgaatctgcctgtgccccctcctggccgtcatccttcttcttgtgacgcatggcaagtcgatgagcctcttgctgcgccttcgcgggctgtagctcatgactttgtggcgaaaccgctttagctgtcgtcactggcaactggtttttaagatcaggatgcacctgtttggtgctagcagagggctctgcagaattagacttatttaccagtttagtttgcggatgctcattgttcatcattcaccttttcagagcttcgtctttattgaactgaagccatttctgattaaacttactatgcttgggctgaaaacgccctttcctagctgctgcgtcaatcgcactaaatccgatgcagcatttgctataaaaacaaaagccaacaagaaaataaaataaaacaccccggcctcatccgaccaaagcattcatccaagcccctaaaaactaccgcccacaacaacaagaagaataacttcctacaaacatatcctctcgctaaaaagttccaaaaacagcgcatcgccttttaaaaaacacagcgcgcagaaaaccaaaagcatcaggatggttagaatctgggcaatgttttcccgattcaatgtcactcctttctggcaaccaccagagccagattattaaatctttgttatgaacagcgtgtccgtttgtaactataagtacaaatagagccgctgatcgatgccaatataggttgagcgcttccacagaccttcgactggtcgagacgatctctacaccgctcaagtttttcagcaacccaatgaacgccatcggcaagccgcaagcataggctcacggctgccgaggcctcgttacagagaaacgtaatgcatcagccgctgatcaccaccccagtggtgctgtggatatccgtcaccacctgcgccagatcagagttaatgacgttcaagccgctctccagttgaatgtgcacctgcgccctatcatccttagcgcttcctcccgcgccccctacatactcaagtggcacaccatgaccatcgccggccgcgaaggtcgacgcgctcatgtcattctggggcgcgctattgtcctgctggtcgatgtacagcagatcgttttggccaaagccagtcaggagcacattcaggtcgccatcgatgctcacaccgtcaccggacagcgtgttgcccgcagccggatcatctccagacagatccttgaccacaaaggcgtaatcgccattgccggcggagatgctcacctcagacccggtgaagcggccattgcccgtaatgtcgacccagcgctggctgtcgaccaaggcaccgttctcgtcgaacttctgtgccaggacaccgccatcgttggcctccgtagcgttgtatacacctgggttgacggtggcgaagtgtgctccgttgaaggcatcgctgacctgccccccggcagtctggaacatcccggcagcggtttcaatgtgatacttgttgcccaggtccagatcgaacgttggattgaggacaatactcttgccgtcagcgctcacgctcacgtggccaccactcaggtcagtaatgaccccattggcgacactgaacgtcaaggactggctattgtccttggcttcgccacgataaccggcgtggctcgcatcgttggcgtcattgaccagcttgatggtccaggtgccgtcggccaaatgccctgcaaggctcgacttgagcacgatgtccgagcgcacgtcaaagttgctggcaccatttacatcactgctgagcaccggattcaacccgacactcaccgcgtgggtctgcgtggcagaaacgttaccggcggcatcggtggcggtagcggtgatggcgtgcgccccgttacccggcacttctgcgctggtaaaggtggtcgaccaggtgccatcagtaccggctgtcacgctatggctgactttgtcccacacgacatcgaccttgctgtccgcctcggcggtaccgctggcggtgacacctgcagcctgctcggcggccgagacgacatcgtcgcccgccacggtggcgatcgttggcacaggcacgaccgtatcgaccttgaccgcatgagtaccggcggtagaaacgttaccggccacatcggtggcgaccgcactgatcgaggtgttgccatcggccggaatgtcggcctgggcaaaggtcgaggaccacttgccatcgacatcggctttcacggtatgttcggcggtgccccacacgaccttcacggagctgccgacctcggcagtaccgttcacgttcaccccggcggtcttctcggtggcattgaccttgtcgtcagtagccaccatgttgatggtgggagcagccacctcggtatcgtaggtgaatttttgctcagtataaaccgaaccagattgggggtttacagccgcgtcaaatgcagtaacccatacggccgaggtattgctcggtaccacatcgctggtgaagtgcgcggaccaatggccagtgctgtccacggctaccgtttgaggcgaaccagggagggaaggaagaaaaaccattacatagccattagcttccgccgtccccgtcaccgtcagaccggcggctttctcagtggcattgatcagattatcgccggtgatcggatcaatagtcgcgtccgccgggcccaccgtatcgacggtgagattgcgttgagtagtcgcggtattgccagcgttatccttgaccaccgccttcagaaccgttgcgccgtccgcaggtacttcattgggggcaaaattcgttgtccaggtaccatcattttgaacagcgacggaatgcgttttatcgcccaatgtcacgtccagtgtagtgcctgcctcagcagtacctttgaccgtgagcgcttgtttttcccaagcgtcgatatagttgtcattgtaatcgtggaagttatccttgccagtgcccctggtcacgctggtgatcaccgccgcactgactaccgtgtccaccgtgacagtctgggtgccggccatagagacgttaccggccacatcggtggcgaccgcactgatcgtgctgctgccgtctttcggaatttcagtcgcggtgaagctcgaggaccacttgccatcggcatcggctttcacggtatgttcggcggtgccccacacgactttcacggagctgtcgccctcggcagtaccgctcacgtttcaccccggccgacttctcagcggcattgatgatgttgtcatcggtgacgtcgttgatcaccggtgcacttgctgccgtgtccaccttgaccgcatgggtaccggctgtggagacgttgccagccacatcggtggcgaccgcactaatagaggtgttgccatcggccggaatgtcggcctgggcaaaggtcgaggaccacttgccatcggcatcggcggtcacggtgtgcacggcggtaccccacgtgaccgccacggagctgtcggcgtcggcagtaccgctcacgtttaccccggcggtcttctcggtggcattgacgatgtcatcagtggcgaccacgctgatcgtcggagccgccacttcggtgtcgtaagtaaacctatgtagcggatgtgtctcagattggatgttattagccaagtcaaagctaaccgcacctgcggcaaaggtgtcattcggtacctgggcgggggtgaagtgcgcggtccaatggccggtactgtccgcgtaaacctcttggctcaccgtcgcatccccgccagttccagtatcaatgcccgagaacaagccaacacggacgcggcaattagcctccgcggttcccgtcaccgtcagacctgcggctttctctgtggcgttaaccacgttatcgctggtgatcggatcaacggtcgcgtttgccggggccgtggtatcgacaatgagattccgttgagcagtcgcgctgttgccagcgttatccgtgaccaccgcactcagaaccgttgcgccgtccgccggtatttccgccgcagtgaacgttgtcgtccagctgccgtcacccataacctcgacatgatgcaccgtgttccctaatgtcacgtccagtgaggtgcccacttcggcagtacccttgaagacggtcaaatctcgacgtttattgaaggcattgatgtatttgtcattgtagagggctaagtctgtgaaaattggcggggccacgaccgtgtccaccagcaccgcgcgggaagcttgagtggagatgttgccgaccacgtcggtagcaatggccttgatcggggtgctgccatcagccggaatttcagtcgcagtgaagttcgaggaccacttgccatcggcagcagcggtcacggtgtgcacggcgctaccccacgtgaccttcacggagctgccggtctcggcagtaccggtcacgctcacgccggcagccttctctgcagcattgacgatgttgttggcggtgactgcatcaatcactggcgcggatgaaatcgtgtcgaccttgaccgcatgggtaccggcggtagaaacgttaccggccccatcggtggcgaccgcactgatcgaggtgctgccgtctgccggaatttcagtcgcagtgaagttcgaggaccacttgccatcggcatcggcggtcacggtgtgcacggcgccaccccacgtgaccgccacggagctgccgtcctcggcagtaccgctcacgtttaccccggcggtcttctcggtggcactgacgatgtcgtcgccagccacgatggcgatcgttggcacagccacgaccgtgtcgaccttgaccgcatgagtaccggctgtagaaacgttaccggccacatcggtggcgaccgcactgatcgaggtgttgccatcggccggaatgtcggccggggcaaaggtcgaggaccacttgccatcggcatcggctttcacggtatgttcggcggtgccccacacgactttcacggagctgccgtcctcggcagtaccggccacgttcacgccggcggtcttctcggtggcattgacgatgtcgtcggtagcgactgcattaatcacaggcgcagcaacggtggtatcgatgaccagtggcacgtctttagaggtcacgttgccagccgggtcggtgacaataatcttcatcaccggattgccatcagcaggaagttcctgatccgagtatggaacctgccagttgccgttgctatctacggggacggtctttggcacgccacccaggttcaccgtcacggtcgaacccggttcagcagtaccggcgatcacgataccatcgtgtttctcctgagcgttgatcttgccgtcgcccccgatcggttgcacgaccgccgcgacaggcgcggccgtatccaccagtacatcgcgggtggccggtgcggaaacgtaacctgtcgaatcgacggcgctcacgctgagcaccgtcttgccatcggcaggcacctcggtgttggagaaggtcgccgaccatttaccgtcagcaccggcagtcacgctcttttgcacgccgccccattccaactggatcttgctgttcgcatcggcgctaccactcaccagcacgccagcctgcttctcagacgaattgaccttgtcatcgctggtcaccgcatcgatcatcggtgccttgacgccccagcgggtgaaggtcgtcatcttccagtcgtcggctgcggtgttggtggtcagcgcaccctgcgccttcagatcatctacgctggcccccaggttctgggtcagcgccagacgcgcggtatcggttcgcaccgcaccgtcggcgaataccaacagatccttctgcatgaccaggtggccgttggcaacgatcacctgctcggtatggccatcgacagtgcgattaaaggtaatggtttgcgcaacggcatcgagcgtcttggtgtagtctgcccacttgcctgtgaagaagatccgatcttcaccgcccagcagctgccgggcatccactgtcgatccggcggtaatgtacacctgatccacgccacccgagccactcaagacctgggtaacaccgggcgtcggcaacgcgaaattcgtcggcgccgcggcaatagcgaaaatgctgcctccaggattgtccggcaacagagtaccgggatggctcgaggtgatactggcattccaatcgtcggctgccgtgttggtggtcagcgcaccctgcgccttcagatcatctacgctggcccccaggttctgggtcagcgccagatgcgcggtatcggttcgcaccgcaccgtcggcgaataccaacagatccttctgcagggtcaggtggccgttggcaacgatcacctgctcggtatggccatcgacagtgcgattaaaggtaatggtttgcgcaacggtatcgagcgtcttggtgtagtctgcccatttgccgccaaacagcacaacgtcggtgccgccgagcaattgccgagcatcgatagaggcgcctgaagcggtccagaccgtgttcggcaagccgttgccactaatctcggcgtctgcattagtcgcgtagtcgtattccacaccatcaagggtatatttcgccccaatgggccggaagtccaacacttcacgatttgcagtctgattaattatataacgtgtagctgccatacttaagacaccttttactattacaggataattttcggacaccaacaacagagtaaattgatcaggcgatctctttaccttaaaccggcaacactcttccattgggtttggcaggcatacacgcccccactcaaagccgcctgccaagcgccggcccagaaaccaagaatgagtgtttttttatagcgatttcataaaaacaagagattcaaagtggcgctaatcggattgccaaatacctattaacgagtccactaacttaacggcctacagctctaactcccccggcctgcgaagcgcgctgtttcaaatgcgccaatacagcctctctaggtccgtcaagagccaccccttgcggtgagagcacgatgattcgatcaacaagttccagaagagccaacttatgggtgaccagtatcaaggtttgtcctgtctggatcgcgccttgcaaggcccgtatacagcgctcttcactggcatcgtccattgaggccgtcggctcatccaaaagccacagttgtggcttggcaagcaatacccgggtgagactgaccaattgcttttgcccaccagaaagcccctctcccccttcggatatacgaagatccagcccctccgggcgcgatgcgagtacactggcaagacctgatagctcggccgcagcgagcactagctcatcggcaacatgaggcatgccaaacgtgagattgtctcgcagcgtgccactgatcaggcgagtggtttgtggaagataaccaacaatttccgcccggcgttccagcgcgatctgttgaatatccagcccgcccaacagcacctgtcccttcgctggttttaccagaccggccagcagcttcaacaacgtgcttttacctgcaccgataccgccaagaatggcgacacgctcccctggactcacacgcagtgagatgctgggcgcagagggctgaccttgataggagaactctacgtttcgcgcttccaaggcgctgctgataacctcaggcgccagaggattcgcaacgccatggttgtctttttgcaatgaaaacagtttctccaaactatccatagcaacccgggcatgcgcccactgcaccaagagccccgggatctgattgacaggcgtcagcacacgccctgagataattgagcaggcgatgatcgcgcccgtagaaagtgcattggttgtggtcgccacataagcacccgtggcaatcaagccgacatagctcacctgctgaatagtagccgtgcaatagctcgcaaagtcgttcagcttcttgacctgcatgctttcatgccccgcctgctgtgacagcgaattccatcgaccctgcatgcgccaggcaccaccagaggacttgagcagctccgctccctgaatggtttcgaccaacagaccttgacgccgattaccgaccaaatccattcgagtggagtgcttttggatggcgcgcttgaaagaaatccctatcgccaatgccacacagaacgaaatagccggaacaatgatgatggccgatccagccagaagaaacatgacaaacaggaagaacaaggcgaacggtgcatcggttgccagatacagaagaagcgcaactttgaagcctcgaacagactcaaatcccttaacttgagccgcgaatgtccccacgctcgccggaaactgatcgagccgtacgctcagcatttgcgcaaagacactctgtgcacacgccacatcaatactgttcacggccctgtccacaatggatgagcgagcaaccttgatgaagaactcgatagcaatggctatcagcacacccacactcagcacaatgagtgtggaaacccctccttgagcaataacccgatcgtacacctgcatgctatataaggacgtcgccagtacaagaatactggccagcgtcgaagccaatgcagcctgaacaatccatgagcggtcggcccggaatatggtgttgaacatgtccttggccgtggaggtgccggctgccgtttccaacatccggacacacagaaaactcgtcccgtcaggccagtttgtaaaacgctcgcgcccttcaggcccctcagccagccaggcgccatcactcgcctgaccatatacgaagcgatacccgcgccccgccaaaagtgcaacagcaggcaggtcgacaccctcaaggcccgagtgccagtgcgccgtgtccagccccagacatttgcaaagctcaaccaccgcgtttgccgccgcgccgtcttcctggccaccagcaagcgcgcaaagccgttggcgctctcgcttattaaatgtgtctttacaggaggtggcagagattaaacgccgccccaaccaaatcaattcgtcactaaacttagccatcaattagttaccacttatcgttctggatccagaattgctgtgctgacgggtctcacttgcgagcgcgcattgcgcaactcacaaggcctctccgcacagcaatttgacgcgaaacgcatacagttccgagtttgcgcgtgccgcagcgagggttcgagcgacatccgtttgttcgcgcaccatattcagcagatccaaccagctacgtttacccgccaggaacatgcgtttgtaggacgcatacacgcgctcgaccccatcgaggttgagcgccccctcctcgcttttgcgcagggcggcgatatacgtttgcgagtcgctggtagcctgggcagagatgtcgcgacgggctgataaataggcctcgttcgccgcatcacgtccagcctgcgccgaacgcacccccgtgaacgaagaaaaaccggcaccaaaactttgttcaacaccaaaaaatgtgcggttgcccggtaccctggccccatcggtctggccctgctgatgttcgaaggtggcatagaacgatggcatcatttgcgagcgtgcttgcttgatgcgagtgtccgcagcccctacttctgcaagcaaccgcgccagcgtaggatgagtcgccagggcacgttgaaccacgtcgccttcagtaatatcgaggcgctctgccatcgtggccaaatcggccagttgatccggcgtaatggagtcgcccgtcagttgcgaaagctgttcagtggaagagcgcaattgcgcctggacggcggaataatcgctacgtgcctgagacaagcgcgaccctagcaggtcaagctcggcttgcgccgacagtccagtcgccagccgccgcgtcatcatggcctgcaacccacccaattcttgcaactcggcggtgagaatttttagctgctgccgggcgctttgcgcatccgcccaggccgacgccacgcgtgccgccaggtcataacgcacttcatccaccgataacaaggcgatttctcgttgagcgttcgcaacatccaatccggacgtaagctttcctccggtccaaatcggctggcgaagtgagtatatttccatctggcgaccttcacggtgctcggcgctgatcgatggagttgggagaaactgcaagcgcgcactgtcaatatcggcgtctgcccgcgccaccgctgccctgctggccagcacacgggggttggtatcgatcgcgtcatggacgagccctttcagcgtccaggtggaaacgttcgatgggttttcagaagcggcgcaacaccagccactcgccacaagagcaaagccacctaccgacagcattcgcgcaagaccccgccgcgtttctcggttcgactgacgcgaagcggccctttgccctaaaacaaaaggggaaaaatattcaatagcggcacctatggctctattgaagtgaaagcgaaacgtttgaaaatcaagttgttcaacagagttattgcgcgaggcaaaaggctcccggttgccactgtgaagcatatgtaaaatcctctaagccgccgaagcctatacaggcattacatcgggtgcttaccaatatcggctctgctaaattgaacaaaagcagctggatgacgcattaacgctttttgccttaggcggttatccggtttctggcgaacacatttgttaacactgcgaccaactttacaattctggaacggggtgacggggtatcgcagttcatttgactacacgtaaatacgcatcgccgtgatatttgtcatccacataggcaggtacatattgctcacgtcataactggcctacacaaaacagactgcctaaataaagcccacgccaaatcgcaagcagcctcatttaaatccaaacgacttgttgacgaaaagttattttttgtcaaaaaaaaatttctcagatcaggctcgattgattgacatttattcaacgcggcgcgtctgtgctcaatgagcctcagcgttattttctccccgttggcaatcgatctgatacaaacacttggcttgtggcgaacgctttcagagcgtcttgtcatttatcccgcgagcagcgaaagcgtgcgacggccttgcgttctaaccctgccgtcgaagtaacaaccactgtttcctgtgcccggcagagcaaagcgatcattttcattacgcataagtgttgcaacaaaaccgagcatcattcttggtttcgacgttgtcaggagttattcggagtgcggtttaattttaatagatatacgtggagtcaacttttggcagcgactacgcttcgactgcgttgttgagttcatcgagcggaaggaaccgcagaatatcctgcctggcgaagagctgacgtacccaacccttgggatggatgaatcaataggcttgcctgagccgcgtcaagctcatccttggccgactaatctggcctgaaacgattagcggctggtcagctggctgctcacggaaaaagtcagtgtcgagcgctggacctggtccacgatgtgaggctgcaacagaaggtttttcgggtgtcgaaatgcccgtctattgtctgaacctcagcgatcgccatggattagagcacggttaggaaaccaagggcggccacgactttgtgaggattcggttacaacggtgccctgctgagcccggttacagataggatctggagcaacggcataaaaggcttccgacctcatcagctcttcgccacgcatgccgaggccaagtagaatgatcaggcgcctctccctgcgatacgaaaaacgtagggccgcgcctgatttacaactcatcgttcgttgaatgcagtagatagcgttttagtaatcggcttggtcagatagctaaacacactgcgctgatgagtgcgtatctctgaggtcacggtcatccccggcattacagcgatcagccccttcgccccgaccagggcggtagccgacacgtgatccaaacggatctgcacacggtagtagactcgctctcctcccttgttatcaggctccgtcaaagcatccggactgatataaataacctcacctgacagccccccatagacgctggaatcataggcgtccagcttcacctcggctggcgaaccctgatggagaaaggcgacatcagcaggtgcatatttggcctcgacgatcagttcgctaccactcggcagcatttccatgatgacctctcctggacgcagtgctgctccgggagtagtcacggcaatttttcgtatcactccatcggtgggagccacaatacgcgtttgctccagcaggacattacgctcccgcaagagctgttcttgcgtcgccaactcttcttcggcgtgagtcatgtccgcttgagcatcttggaaaaatttgttccgcagattgacaatttgaccttgaagctcggtttcttgccgcttaagacgaataacctctgcctttcccacatcaccgtcatgaagaagaggttcagtaatattcaattcagccaaaaccagatttcgattggccgcaatggccgagatgccctcttgcagggcctgtttacgcacgcgatacagttgagattggttctcgcgaaatgcagtgaattgctcgatgtcggcgggaaatactaaaggctggctataaacttccgctctcaaacgtgccaggcttgctttaagtgctgccactttattgcgactatcttcaaccgccgccaatgccctgtcttgatccatcctggccagcaactggccccgcgtaaccgcctgtccttcttctacgtatatctcgcctagcacgccctcttgtgaagcctgaatcacttgggtgcgtgcaaccgcgatcacctgcccacgagcgcgtgccaactcatcaatattgaagtaaacagaccagatgccaaacaacgagatcccgattaaaacaatcaaaatcaagcgagccgcgcccccctttcggcgccggtgccgagtgtattcctctgaagaaaaagcttgcgtgcgtgacattttagacaccttaaacacaatgtaatcctctctactacctgaaatcagcggccaccccaaaaaaaacaaacgccacagcatggcgctatttatgtgagtaggattatttccccttgccagctcaccattagagagccgtttaataatgaacaacacccaaagtcgattgcaatcactggctaatttgagcaccgctgtgcgaatgcgcaaaaacgaccgacacatcgagaaccccggcccgcgctggcgaggcgcgcatcacagaatgaatcgacattttactactgcaaaaattacaacaccaaaaaagccaactaaaaataatataaaataatatctattttcttcgcttgtcatttttcgccttctgacgcttccctgcgcctaagcaaaaacgtttagggaattcgtataaaacaacacgctaacgctgttaaaattcaagaaatctctattaaatcagcaaaagctgttgttggcggcagtcttaatgtcctcgcgactggctttttgaccggcaccggtatgggttaatttatcggctttgctgtggctggcgaaaagtattccagaaaatggaagatttgctacggttttagtcatttagtaaggctgggaggattaaaatcttcccagctttatttagtgttttgggcaggttctctcttgagcgacagcgaggagcaatgcgcgattcgacgggcattgaatgcaacgacgaccggcattcatgccccccctggttgcttcagttttctgcccccgcaggctcgcttattaccgcttaaggcttttgccagattctcattcagggctcaagatcaggtttttctgatacgtcttcactgtctgcggccgcgagcaatgctgcaatgccctctcggaaaggatgaaggtttctgtccacaatgaacatggcgttgcgcacgttttcggcgagctcaacagagcctcgttgttccacccagtgattcaactcttcaaccgccgcggcgagtgccaattcgttctggtgctgtctcttaagcagacttgcaatcagtttcaggctgttcatgcgcctctccgaagcagcttgtacaatttaaatgtttaggcaactatcgatatcgccccacctaaggctgcgctgtgcgcaggccctcattctcgtgtcctctcgcggtttcgcgaaccttggctgcctccaaagcttttcgtctgaaccgaataacccgtggatcgttacgcgaaatttcgatcttttgtgcgcgtgcgtctgtaaggattttcctcaatagtgcgagaggtcaaaaagcgtaatcggtagagatccttgctcagcgactacttggaagggaaaagtcttcgttccagtgctcatgttggcctggcctgccccacactgccgtctggtcctggtacaacctggtaaaggccgtgaagaccattacgcctatcctgtgctagcaaaaaagacgcgttcaggcggacgcttttttacgctgcctttatgtcaacaactgatgaagcatattcggaaaatccctacagacaggtcacatgcaacgtcgcaaattttcctctaagagcgggtgacgtcaccacgcctttgcacgataagagggaaacttgatgcaacggatattatttagcacggtcgtctatgccacttgtctgaccggcctgctgctgttgacggggtgcttgcccaagagctatgagttttccatggcagcagactggcggcacgacaaaaaacttcaggccgctgttacaaaacttaccgctgaagaacaaatgctttttgcagcgtataccgtacgccttgaacaaggtgggccggctgaattgaatgcctcagggatgatttcggtcggtgaagccattgagatgcaacgccaatggcaggcagagcacagggtaaagaatctgcccccacccgcgcctcaaaccccgctcgacgatgcgtcgccctacggcgggttggtcaatgacatgcaaacagcggcgatgccctcggtaacgtcgttcagttattcgaatgagaaatctgtcgagagttggaatctgagtatgtcattcaaaaataacagcagcaaaacgatcaacggcatattgggcacgatcgtcatcagaaatgaccgcggcactgagctgaaacgttcgaccctgcaggtggatgcgaccattcagcctggcgcggtgctgaacaagacttggcaattcgattacaacagcaagaacccgcacgacttgaccttgcgcaaaaccgatgagacaaatctggtcttttcctggtatccgtttacgtatcgctttgctgatggaaccagtctgacccttgccaagtagcgcagtgcgatggcctgcatttaagaaactgatcctacagtgattgcccaatgtatctatggggcatgcacgtggtgcgtaatgagctcttcagtcgcacacttaaaggcgacaatagccaaatgtttgatttgtctagcgggcatccatcgcgttcgagatgtatcagaccaagaaaagtaaccagtatttcttcgggatgaaggatattggcgccgatgtagagccaggcctggttcatcatgtccatggcaccgccgccaatgtggccgatgtcacacaggtcgccgagctgctgcatggcgaggaaaacgccgtgtatgcagacgccggatacactgaagagcacgaaagtcgtgaggtaatctggcagatcgctgccaggcgcagcacctattccaagctgaataagcgcggcctgatctacaaggccaagcgtaaaatcgagtatctcaaagcccagacgcgggccaaggttgaacattcgttccgggtgatcaagcgccagtttggttatgtgaaagagcgctttcgtgggctgatgaaaaatacggcttaactgaccacggtgttcgttctggcaaacctctggatgaccgataccggcgcctacagtgacttggtgttcggggtgttccgcctgctcggctacgacttcagcccacgcctggccgacgcggcggcacccgcttctggcgctcgcgcacggacgcggactacggcaagctcaagggcctggctcggcagtcgatcaagcttgacctgatcgctgagcactgggatgacctgctgcgcctagccggctcgctcaagctcggccgcatcccggccaccggcatcatgcgcaccctgcaaacgggggatcgacccacccggttggcccaggcgctggccgagttcgggcgcatcgagaagcccctgcacacgttgacctacattgatgacgagtccaagcgacgcgccactctgaccccagttgtaccggggcgagggcggcacagcctggcccgcgccgtgttccacggcaagcgcggtgagatgcgtcaacgctaccgcgaaaacgccaggaagaccaactcagcgcccacggcctggtggtcaacatcattgtgctgtggaacaccctctaccgccgccgtggaacggctcaggcagtccagctacccggtgcaggaggaagatgtggcccggctgtcgccgctgatccacgagcacatcaacatgctcggccgttactcgttcgcggtgccggaagaggttgcccgaggcgagcagcggccgttgcgcaatccagaggatgaagtatagatgagatccagggtgcttcgttgaagggcctggctgatgatgaagggtcaattgtggccggtgtcgatcagagtaaaaaacagagtctttacccgcatatcttccgtgtactgaaaaatacacgcgcattgagatgggtttcctcattgagcgtgtaggcatcatggccaccgaccattccgatattgggaatctttctagggccgcttgactccatgagtgggccgaaattcgatccatccggtgccttgcggaactggaagcacacccgcgtagccgcggcgctcatcatcgctaactgctcggcggtgtacagcgtcgaccggcgggcgacagcccgcgcacctgatggacaggaattacgctggtgaactggcttgcgtaggagccctcgcggatcgccttggcccacacctggggcgcggcctcggcccgcaccgccagagccggggcaatgccgaccgagccctgcacgtcagcgatgacggtgctctgcgtggcgatcaaccggtggtgtcgaacgggcaaccgcactgcacggcatgcccgtgggtggccagggctaagtcgatgacggtggagttgcgcccacggcgatgaagccaatgctcttgcaggctggacaccacacgggatcgctgatccgggcggcttggcgaaactcaacggtatgcgtggaagagccggccaccacaataccgcccgtggtggtggggtcgccttccctgatgacaaaggccatggttagtccctcgtaggcgtatggagggtgaagcctaccaggcgtgtcccagggagtcgcttgcgcggttcacggatcagacaaggctcatgttggtatttggttccattgctccccaaacctcaacatcaccgtcatcgaacccagcgctgagcactattaccagccggcctggaccttggtcggcggcggcgcctttgatttgaaaaacacggtgcggccaatgtccgcagtgataccgcgccaggctcaatcgctgctgactgcggtcagcaaggtcgaccccgagaaccgcttgctgagcctcgatgacggtcgcagcgttacctatctgaacctgatcgtgtgcccaggtctgcgcctggcctggggaaaaatcgaaggcctgcaagcgcccctcgggcagcacggcgtcacgtccaactatggctatcagcatgcggcctacacctggcaactggtcaaaggcttgcgcggtggcgaggcaaactttacccagacagacgttccgatcaaatgtgccggtgcaccgcagaaggcactgtacctgtcctgtgatcactggctgcgacaaggggggttgaagaacttcgacgtcgagttgaacctcgccggtgccgtgctgttcggcgtagcaaccttcgtcccacccttgaggaagtacgtcgaaaaataccgtgcgcggctggtattcaactcgacgcttatgaaggtcgatgggccatcgcaaaccgcttggtacaagattaaggacgcccaccctgcaagcgataaaattcgatttgctgcacgtggtgccaacgtaggtggcgccgaacttcatccgtcatagttcactggcaaacgctgacggctggtgcgaagttgacgctcacagtttgcagcatgtgcgttatccgcaagtgttcgccctcggcgatgcctgctcaaccagcaacgcgaagaccgccgccgttcgcaagcaagtcgttgtggttgccgaaaatctgttggccttgcgcaagcagcaaccgttcccacagaaatacgatggacatggcgcctgcccgctgatggtggagaggggcaaggtgatactcgccgagttcggttatgccggtaagttattgccgacctttcctctcgatccgacggtggcgcggcgtttggcctggtatctcaaggcaagttttttgccatggttttactggaatggcatgctcaaaggtcgcgagtgactaccccgtatgtccaaggttgattgaaagccctcttcaggtgcgacattgccgggggtgccgtgaccatgcagttcccgatggtcacggttttgccgtcaaccgatcaaatacccgtttgggatagttaaaagcctattgcgtttcgggtgaaaaacactacacaattgcccgctgtttgcactctcgaatccgcggaaggagcgccgacaattataggtaaaggttgggtggaaagcttcagcacaagtcaggtgccctgtactgagtgggtcgcagtctaaagcctcatgataaacaccataatgcaatagggcggcacaacattcacgacatgactatgtggagattggctgcccgaagcggaatgactgtgcgatgcattcccccctacggactccgacctggcgagtctcgcctgactacgattcccgtcaacttgatctgtgctgatagaaccttgtacgccaccgttaccactcacatcgtatccataccttgtaacattgggtacgctgctgtcgtccctcaactgtaggccgccatgatgagagtgcgagggaatttgcgatagggataatgtcgtccccgcaacattaacgttaatggtgggagccatggtattagtcgtggccgtataggttttggcagccgccgttccgcttactgtctgggaagtggcgatgcccttatcagccatggtgccgcccataatgaaacggtcccttaagtccggagtgcctcgcgagccatcacaaatagcccatccgcttggaatcgcactcccgtagaacatcatgatcatacccgaaggtagcaatgagggcacatcaacactgacgccagcgctaccaacggtaatccccggacctgcttgaatcgcgataccgttggcgccgacactaagccctttgttggcttcaatatcgacgcccaccacgttgtcattgaccttaatccctttttcaggatctgccgtcacagcgttcacccgctgccaagcagtaaataccgcagcaccatcgtgtttggctcttaaccacatgccgcctaccgcattaaagtagatctgcgtacagtccaggctattatcaggagtataagtaaacaacttcaagaacgcatttcccgccaggccgtcggcggtggctggccgattcggataggtgcatccattatccactccgtacacccctgttttataggcaggaggtataacggtatccaagtcgacacccttagaaagcgtcgataaagacgcgtgaaaagaatccgccacttccagcttgtcctcagccactttcaaactggtgccgaagttaataccgatgccattgacatcaaccttaatgccgtggcttgcatcgggaataataccaacacccgcgctatccacttgaacgccaccggcggctttgggctgcacggccagcttctgtgaagcatccagctgcagtccaagaccaggaataccatcttgtgcgggtgacagccccaccgccttgcggccgacatctgccacatcgatcaagtcggaaaaattggaggccagagggacttgttggatcccaaagacatctttcagcttctcaacactcggacctacagcgtcctgcccaattgtatcaaccatgtttatactcctttttttaaataaagttgccacgtgccttaattaaaaaagcactgccacgcgggtgattactaccacgaacctcatgcaagaatgttgatgcgggatatatgtttcatgctcgataatacccgctcaagaaattggtgtcagacaaaatagagtccgaattcaggcgggcggattcccgttcgaaacaccgctgtcgaccctggcgccgacaatagatggtactaactggcgctctattgagctgttcattgacgcgtatcgtttcttctatgagcctgcctgaactttcttttctagtgatgaatgactccgtctcggaggcgaggaatcgttccccgggaacagtctgattttggatgagggtaatggatgcacccgcttttttatggttcttcacggattaccgggaaagacgctcttgatcttcatgaaaaagaattcgctatcccggtatccgtacgccatccgtttgaagcgctctacaaaatcccccatgcaggacactagcccttgccatgacagtgtgagggtggccggagggcgttcgtctgcaacgccaaaacaccgcaccctcctccacatggaccagtaatgcgttacggattgtgtgccttgtaggccgcttccgtaggggcccgcaggttcttggcatgctgataagcaggtgggaaccataaggtgtcacccggttgcgtcgtgaagtgccttgcattgggtggcgatatgcgcaaccgaccctgcccttttgacgagcactcgacaagagagcctgcgtccaaggtgtgagtgaccccattgcttctgagcacggcgcctactggggtccagcattgcttaccaggcgagacctttctctcggatagatagctggttaccggtggcaacgggcttgcgccctctggtacctgagggtttcatcgtttcggctaaagcaatacccgagaatgacatggttgcccagatcgtcaatcagtcccttgacgtccgcttcggtcattttagccccgtcatagatgcggattcgactttcgaaactaccctttggagccgagtcggaaacgtagtattcaagaccgattttcgcatctttttttaagagataaccggacaagtcgcctttgactcgttgtttgttgctattaaatccgtaaaacacgccgctcgtgttgttctgaacaaatgtttcgtttatacgggcgacgatgtcttcactcaagaaggcctgctcgtgctggcctgccggtcgtccacccgtatcgtcccagttgttcccatgccaggaaccgtggacgcctgacacgatggcaatgggccgttgtgtgaagctttttcttcgttcaagcacgtcaagcggcatggtactggttccccccgcttttcgatcacccagctcagggccctcgatgggcctgtcagcgccccacacgtattgatgtttatttcgattgaagagataagggctcgactgggcctccttgcgccaataatcctctcccgcgggacgctcaaattcaaacttccaacgcggtggagccaagccggtatttccatgggaagctccgttaagataagccgggccgcgagtgctggaggtggtttctactttatctgacagcgatcctgtcgtgccaatgtggctctggtttgaggcatgtttctctccttggattatcctgggtagatcttttgatgcttatttcatacaggttaaggatttgagttttaaggcaaggtattgcccaaggaatatcagcgatgcagcggctgcccacaccgtttcgtttatgcaagccacagtcagcggcgcctcaaaagtcagccagcgaggttcgccttattgacctgttagcgagacgggaatgctcgaccgccatcagcggtggttctatgggtgctgcatgaaagtttagcgtgacgattgtttcgcgactatttggatcaagaacaaaaaattgcctcgattgattttcgaaaagtagtttctcgtattatattgcagcaacaattaataattttccgccctctgtgacttaactataatccagctgctcaacaattaaagcaaagtccactttcaggttgttgggagggtatggctacccactcacgttacggcacggaaaaattaatcgccggtatcggcttacggccatacaatgttcagcggcgactccaaccacgcaaacggcacctggtttttcgaccacggcaagtcgatcagcaagacgtcacaggcatcgtcctcgacctccaatcgccattgccccttctgccagctcagccatcccgggcgttgcaggaaccagcgacgcacttcatcggaactacagcgcgccagagcgggggtttgggctaacagggcttgcagcagctcatccagtccggcccgggcctcgactcccagctcagcccagggtaacagtggtgtgtccaaaggcagtccacacagcaattgggtgagtggggtgcgccattgcgcctgcgcaccatccccccacagccactcatccagccagcacactgccctgcactgcgcctgtcgatctatgaactggccctgcttctgcaggtcgaggcgactgaacaaacccggcagcaaaggccagagcagtaccaggccggcattactgacgagccacggctcagacgcctcgcttgtcgggaggtggcgactgcttgatccgggggctgaggcttgctgtcctgatcggttactcaaccctgatccgtcttggttttcgcagggttctgaagtctttggcgccttgtccccttgtccgttctttgacggcgatggctgctcctcgagcagaagagcgcgcagacgatggcgctgcgcttgaccgatgaacggcgcaaggtggggccattggccggactcgaggcagagcagacgcagccagcggagcaaggcaggcgacggtaagcagttggacagctcgacaacggcatcggcgagaaaaggcagtacctcacgcggcaactccaagctgccaagcagttgcatgaaacgagcagattcaggttctggtatctgcgaagaggcctgccttgcctgggccaacaaggccccaaggatcaggctaaaggccccagccgatttatcctgcgccggccacggcccgctgcgctcatacagcagaacgcacgcctcgcccaggcccgcctcccctaaactttgcaacaagcgcaccgtcgcgccaaacctcaaaacgctacgggacaagacccggcgccaggaggccggatcggtgtacaggtgtagcactaaccagtcgtctgaacgactggccaggcactcgctcaacgcgcggcccgccaagccatggttcaaaaatgtcgccagttgtgaccgcagcgtggcggcaagcgaaagcgtcgtctcgcggcccggctcgcgcgtgcgggtctgtagggagacccgctgatcagtaaccctcttacccccttcagaacccgtctggctggggcatgtcggtagcgctacgccgtcctcgcgccgaagtccgccctcatgcttgaccatcaggggccttagcctggcggccaaggctgacagcagatgtcggccgaactgatcatcaaactgggtcaggggaatctcgcccaggtccagcacaatggacgacacctcaaccgcgccttcgcccgtctgaccgatctgctccagcaatgtcgccaagtcttggcgacattgctgatgaaacaatcgtcggcagcgatcaagcagcggattggcgatgtccatgcgtgcatcaagaatgatgtgaagtttctctatcctgctcaaatcaagactctctgatcacagtggaggattgccaacgaccacgcttttgttcttccctggtgacaggttgatccaaaaccacgcaggacgaggcgggatagtgcgttataacttcatgataaaagccaggatgtaatagagaccgtatgaccatgggcgccctgagtggccgaggcgctatgggagtggggagcacctgaaccgttggagtcggtcatgctcctgttgttgggggtcggggtgttgcccgtggtcaaactggtgtacccccctgcgcccgaaccggtgttccaggtcactttcgagctgtgttggtgagcaggcatctgggccaccgtcaaggaggttccattcaccgtcacgttgatcgcaccggccgacaccttgtcggtaggcaccgcacacgttttgacagcgctcgttcccgacactggcgtgccgcctgcatgaatcggttgcatcgcacagcgcccagccctgcggaatgacggcccctgaaaacatgacaatcaaaccttggggaatgccggcattggcgaccacctccagtttgccgtcagccttctgcaagctggcgccgaaattgatcccaatgccgctggcattcacacccatgccccggctcgcatcaacgaccatcccgacaccactggcgtctaccttgataccctgatccacatcggcgatcacaccgacaccagtgctgtctaccgcaatgcttttggttgcagggccagcttttctgaggcatccagctgcaatcccaggccgggaatgccatcctgttcgggtgattgtcctgccgctttgcgcccggcatcggccacatcgatcaaatcggaaaaattggaggcgagtggcacgtattgaaccccaaacacatttttcaaaaatgtccactgtcggaccgactgcgttccgcacagtatcaactatcggtgtattcctttatttgtattactgaagccgcgcaaccaatagatttttctcagctgacatcgcgtttacgcaatctctggcgccccgtcgcacgacgtatcggtttaatctgaatcatacttcatcattaattcgatgccagacaaactgaagtctgaattcaggcgataaaatataaacagattgcaatcatgcgcagacgataagtgacgcagcaatttaaaacagcggggaaccagcccagttagcagggcaacagctctcccgcctgacagccttagactggcggtgtgtaaagcagcatgtgggtcttgatgtagtcgaagttccagtccggttgagtagcgctggtttgttgttgctgcgtcgcaatacgcatcgcattgatcccttgagccccttcaggtggcagccccagagcgagcgacttcatgaggtaatacgacagcaatcccaactgcccgtgtttcatggtctgccagcgtgtataagcccacgaaaagtcattgaaggcatcctcgctcaaccacagcacgctggccgttacatgacagggcaattcatcctgaatgacgttttttacccaggcatcgatcatgtaaggatcattggtattcgccagcagattgcgattgaaaaccacagtgacgttaaaagagaagcggtcagtggcttgaggcgcttcaacatgccaaaggtattgaagctgatcgtcgggcgtcggcagtgccgggccggactgccactggatttgaaactcactggcgatggcgttgactttgatgaccttggcatgggtcatgacactgtcatggttgccagtcgtggattccaggtaaatggcaatggtttcattttcctgaagatttctgggcaatggttcgactttaatccagggcaaggttgtatcagtggcctgaccaggcacatacgtcaggttgtaggtcatgtccctgagccacaacgcgctgttggaccagcgcaaggttttctgatttttggcctcggtcagttgcggcaagctgctttgcagctgcacattgtcgttcaagtccagatacaccgtattggcgacgacattcgtcaccatgccggtaatgacgtagggatcgttattgtcactcaagatcgtcaggtcaatcagcaacccaggctgcagccccgtcacctgagcgtccaatgtcaggatcagcgacgaggtggtgtctgtcgtgtccacggcaatagcgtcgaccggttgcaagttgtcataacgcggatccggctcctgcggcatcaggctgatgttttccatcagataaaacggcagctctgtcacgtcagtatcgggggtatccacgaacaattgcttggccacccccagtcgggcggcaatcctgcgctgcagcgccgagatgtcagccttggaaaactgattgcgggcgtagcccagttcgctgtgctgcttgaggtagccccgctggatggtcaggaaatcatcgtcagagacgtccagcaacgtccggtcggaacggttgtcgccaaagtaccccaacaagtattcaataatggacagttcctggttgtagtcctggcgttgttgctggatccattgcttgagcgcgtccgagtaaccggcatgaacggcgttggccagcgccccaagcacaaatggccattgtccaccgatgacctgcgcaccttctgtcgcgctgcggtcaaaggccagcaagcgaggcagactggccaactggtcacaaccattggctaacagttgctcgaagggtaacaggaactgatacagctgttgcgccgcggcttctgcgggggtttgctgcaagccataacaaggcgggatggtgtcactgaccggatagtagcggcctgggttacggtagcgcccgtacggaaatacgactggactttcattgatcacagccgttctgggcagggcttgctcgatggcggccttcgtcgctttcaactgctggccacgtttcatcagctgaacctgaaccccgtcggccagcacctgtaacgggtctgcgccccacagacgcaccgataccccggcaggcaagctgcacgtccagccggcgttcatgaaccccagggtcttgagatacttgaccccgtccatggccagcaattgattgaccagagggttgatgttcaaggtaaagcctgtcgaataatcctgtggcgccggcaattcagtaatccagccgtgctgaagtcggggcccctggtagatctgttcattgctcagcccctgcgcactcaattgggcggcactgaatcgcttcgcctgggggctgaggtaagactccaacgtcgtataaatatcggccagcaactggggcgtatcgacaaaatcgtcttccagttcgatgagcaactggacactcacgtcctgaggttgtacccaggtgaccggaccgaaccattcacacacgttgcggttgttggccagaaacgcttgcaggaccggttcggcatccgcctggctgacgccccgattcaactcgaccagtaatttgtacatgcccttgaggataaacagctgaggggacgcacatgtgctggttccacgtcggaaaataaactcgcgattgtcagcgtcataccagtagccgtaattgtaggcatagtgctcgtccaccaagagcacctgaacatcgcgaaaatagaagctgccgctgtcatcgttgctgctgcgcagatccaggatggcgcgtcgataatcatcgaccgtgacaggggatccggtcagtgtccgatcgggaccgaaactggtgggaaacagtccctccccgctttgctgtaccggtgtaagcaaatcggtcaatggcagcgtatggcgataacctaaatccgagacggcataactcaaaccttgcagcagggtgacccctggatcatggtcggcagtgtcgctccaagtgcctttggcataacaatccagatccgacagggcctgctgccacaactgatcatagtggatggacggttgaacttgctgtgtggatggggtggagtccttcatacattttcctaaatagactgaggctcaactggcgccgttgtatccggtccgtcagcgagccatgcgacgaccaatgcgcctattaaaatttgaaaatcattactgaccagcctgttcgaacatcgctttttgatactgtcgatatagcgcgtgcgttaagcgatgagcacaaacaagcttgtcgcgcactccgccgtttacccggcatccagtgtgcggtagatccatcaataaatattttcaacttattgcgaaatgggctcccattgcgggatcaatacttgagtcggcgcgcattcaatggaatccatgcccccattcaaggtaaagagcacgacttgttcaacaaagggctgctgttgaataaaagccaacatttcatagtagtccatgcgacatcccggactggcctcgctgtgcccgtcccaagcccacgggatatagtgttgaagcagcaattgattaagctggctataaccatactcaggactgatcgatcgactgaatacaatttgatactgcccggccacgtcaatatagacagggttgaccagcgaaagcttgacccagggagacgttcgctcttgcaggaagcgccgcatggtatccagacgcgccatgttgaaaaccggtctgagcgggtcgctgttgtccatttggccgtgctcgggaatgaccatgatggtttgcagatcggccgagagcggctccactgcgccctctgctgtaggcgtgtagacgtcgtgaatctcggggaactgctccagcagcaaggcacgcatatctctccaggtctgcccccggccacgatgagccagctgctgcgccacgcgctggttaaacagtgcagacgactcgctggcccgtcccccggtagaggcccatggctgaacgacgctgcctaggccgtcaatcggttgtgccgcctgggtgatggtgctggccggcaggggttgagcaaaatgggcgggatcaagcgtctgcgcctggctcaaagtggcggtcatgctgttgaatagcaacgcctgtacccaggggtagctggagatgttcgcgctatcagaatcggcgggcggcgtcaccagaatacggacccagtagcgtccggccggcatccagggcacctgggtggccgcatcgcccggcaaggaggccgtccacaggcctgagtcgaacaggccgccggtgccatccaccaccgtcgcgttgagcgattgccattggttggcgagatccaggtattgaaagctcagcgcaaggggctgcggactttgcaatttccagtagagggaaaggtgctgcccggcttgcatcgaactgaagcccaggtagagctgaggctgatcgacatcgtcagccgcggcgtcggcgtttcggtaaccaaaaggcgtcaacaggtactgggtatcaagcgttgaatccacgaggctgtattcaacgtttacgctcttccattgcgggatgtaaggctggttaagtgccgctgtgttgaccggcgatgccccggccggctcaagcacaaaatcttgcccaaccagctccagccgcactcgactgtcccaatcctctgggtcggcgctgtcgcagggttgggctggcagattgctgaatgcaggcagcgtcagcgcgatgcccacaggcgcactggtaccctcggcaaacagcggcagtggcgtgcccaggctctcccaaccagcgtcggtgtagatcttgggctgcaccgtgaacccctgattggataccgggccattcttatagccctcgtaccagcctgcaaagctttcgttgggcagcccctgccattgcggcgtcaccgtgaccgtaatcggtgccgctttgcggcaccagtccgccgccatcaagctgcagaagctgacctcggcttcaggggattgcccaaaggggtaactggcgcgatccagcgaattgctgccagcgtctgtaccgaagcgcacctgggtattttgagccactttgacttcaaggctggtcaccgcaggcaccggcagaccgtctggacggctgagtttcaataccggggtagtgaccacaaaaccatccaggccattggcggcggtaatggccgggccatccgcgcctaggctgaagctatagccgtcgcctggggtcaggctgacccaaccattcgcggtactgacctgagcctgtatctggccggcggcaggcgtggaggcaaaatggatttgcacggtgcgctgaccgcctgacagggccaaggcgtctgacgccacgacccgaccggagatgatcggctgttctgaatggccttgcgccgaaaacaggcgactgccctgtgccggccacgtcaccttttgactgtcatcctgcagcacacagaacagcggcagccctgtcgaggggcgacaccaacggacgtcggtcaattgcccctggttggcctgtagcggttgatccagctggtattgaaccaggttgccctgaggatcttgaccggcgctgagcaaggtgccggcgggcaacaacaactccgtcgtgttctttttcaggccaaaggacaagaccacttgatcgggctcggctggacgctgcgtgagccccagataatttcgatagtacagttgacggtgagcattggagagcgcgttgaacagctctacaggggtttgcagttgatgcagcagggccaacaaaaaggcctgctgtggggccagctgtccatccgcctgttcaggggcagcatacagcgcgaccagctgatcaatatcatcagccccaccaggaaagagtacgttcgcccagctgtgttgcgcactgccgggaaatggaatttgactcgcgtattcgaaaacgtagctcaagcgctgccgaacagtgcggttatccagctggaacggcatgtcctcagagacagttattgagtttgacatcattcatgttcctttccatatcattcaaaaccctcgaagagggcaaaatccctacggtcagtctctcagcgcccatgacgctcaggcaccaatcactgcgccttcacacgctgctggctcgcttgaaaacttccggttcccgtggaggggatggcggggtcgggcgttgacgccggcggcggcatcagcgccggcagagtcggtacaaactgcgccttgaacttctcgcccaggagaatgaccggctggccgcagagggttttctgggcttgttgactggtatcgagcgccaggatggtgagcaccccgctaccggggatgctgttggacggtgtcgtataggggacgttttcgatcatcacctgcttttcatcccccaggacacacaccttctttttattgatcgtggctttgccagttccgctgatcgtggtcgggggggcaatcacagtacgattgccaaagctctgatcaaacttcaccacatcgccattgatgacaatccagtcgctcatagcacactcattccctgcccatcggcgatattcagtaaggcattgagctgtccggtcatattgctgccgcgaacccgatacgccacgttcacgtcgagctgactcggggtgtcctggttttgggtgacttgaagcgacaatatggccacccgcgtttcataacgcaggatgctgtcggtaatgtttcgctcgatgctggccagcagatcgtcacagatgttttcaaacatgacgctgttcaggtcacagccataatcggggagcatcaatcgctcgcccgtggtggtgttgaacagaatctgcaagctctgacggatatcttcctgatcttcgaccatgctcaccccttgttgggaggtcaggggaatggtgaagttgggaggaaacgcccagccgcgtccgtaaatgccgctcgctttattgttcatgatgactccttagagcgtaaaaccgaataattcagagttcgccgtacttaaaggcgaagccgtgacacagatgccgcgcgttatatcgcgggcggcttctgctcactgttctggagtattggtgctacgcgttattatccaagctcgattgccttgccttgtatttgtactaagctcgtgcccgttgcactcagtttctttgcgctaatctcaatctcgttgttacttttcagcgtagacttctgctcggcactggcttgtatgttgttgcctttgagattgacatcctgatcggaactcacctcgatgccctttttgaagttcaagtgatctttgtcatattgcaacgacaaactgccctcctcggtatcgaacaggagctgtcgggtattgtcgtctttgacaaacaccagaccctttttattgttggcctgactgggtgcaaagggggcgttgttttgcgggttgtgcatggatcccaatatgaccggataacgaggatcctgggcaaagaaccccagcaccacctcatcgcccggctcggggtacaggcataggccgctgtccttgctggcatagggcatgctgaagcgcgcccacagcgacttgtcccccagcgccggcaccttgacccgcaaccgattaagactttgcggatcctcctcgaagtcgtcgacaaggcccacatgcagcccggtaacgcccggcaacaacgcctcgccgatatcattgagggtgtcctggcccagcgtcacgacggtctgccagatgccacggctgattttgtgctgcaccgaactgatgatcccctgaccatcaaacgcctgaccaaagcccttcaaggccagagtgtcacccaactggtaggtcgtatccccagccagggtaaagcgggcctgtaccccctgggcctgcaaggccaggtaacggctgtccgccagggctttcaactcgcttggcatcaggttcaggctcgaggtcagcaaccattgctcctgatccggcatcgacagccgatccggttgcaggccctgtgcgcccagcgtaaagggtttgccctgaacactttgcgacatcacctgttgctcgatgtcccaggacgtcgccgccagggtgccgggttgctccagtccattgaactgccagtacgcctcggtaatcagcgcgtcctcctgccccatcggggccaccagttgggattgatagagggtgtgcggtgccacgccgctggcgaccatcggttcggtcaccgagacgccgccttcggcctccggtaccagccagacgccattggcattcagcctggatttgacaaactgccagtcggagcacccacactgaaccatctgtgggtgcacgaccgacaagccggccatgctgtctccctgctggatctgatggtcctgcaacagctgctgcaggatctgtttatcgctcatctgttcgaaaagctgatttctgtaggtggccaccagcttttgcagcggatgacgcaacttcagcgtaacttctgaacgccccatttggacgctgtaactttgttgctgcacaaccccgctgaacaccaccacgggtggggtgagcgaggtgatcttgatcaccactggcgtgcctggctggcacagcgtgaagtcaccggccagcgttgtctgatccgacgatgagccgcccggcgccgatagaaccaccttggctgacgggatttgattcaccgtcagcctggtgtcgagccaaaccgcctgcaggtgggtcagtggctgctgatcaacaccaaacaacacttcgatttccaggaacgaagccgtactggacgtactcatgcttacacctcgctcttaaggcacgaccagcgtgtcgccgggtgaaaagtcgttgagattgctcagaccattggccgcggccagtgccagataatccacccccgcgctgacggctcccgcgcctgtcgcgaccccggccgcgatcagggccagtgacgacatggcaggcacgctcaaggtgccgacctgaggcgcgctctgaccttgcagagacttttgcaggagcaggctttcatcggtacgcaggctcagtgaggcctctgcccgtaacggcgtggcgttacgatcaaacaggctgtaattgaccgacatggccgccatgcggcctgcgtaatagccttggccgctccagttcatcttgccccataccactttaagaaaaggggtttcctgggtctcgggcagcacagagcagcacagcgcacgtaactgggccaattgggcatcgacggttttccggttccccggcaacagggcatcgaagaccagtttgagatttagctcgcccggacgcacctgctgatagcgactgctttgttgcgtgctgttgatgtgctcatccgtgacataatcggtgctgtagctcaggccgatcgattcagggttgtacatcgcctgcagggtgccgaccagtttgcgaagctcccgatcctgataggcactgatcgtcagtttggacaatcctcgttccagatatcccatcaccgctgctcccgctcatcacgtaaacgttccagtacctgttgggtgatttgttccaccagccggttctgctccctccgccccagcgactcccacgaccagccacgggcgctgccctgcgaagcggcatcgacgacccgggcctgaatcaccagttcctgaatttcgatggtcatgctttaacccccagccattgcatatcgctgtaggccagctccaagcgattgatgagcaccgtattgctcgtggcatccagatccccggtctgccagttgaccggcagggcgtcggtgaccgtccaggtgcaaaccggcaatgagttctggttcaacaacatgatcaccagatccacgtattgagggtcaaagttgctcagtacctcattgaagatcatggtcaacggcgtgacgaccatgacgccacgctccagtaccagaggggggtgtttgatgcgatcaggtaaataaaggctcttttcgttctcaccgccgccccgatgctcgctgacctgcagctctcggcccaggcctgttatgcgctgaaatcgaatgtccagggggcttgggatgttcttgaaaaacagggtggtcaaaaagcggtgcgacacggagggttcaaacagtttttccaaggcactcatggcgcggctccctggttagtgtccggcacggaaatgtccaccacatcgaaacgcaggtggagctcgataaactcggccgggtaaagggcagacaccctgacgttcatgatcaggcggcccgccttgatatcatcggccgtcatgctttcattcaggcccacagacagttcaaaggcatcgctctcaacgccgccaaacaacccgccactgagccatagcttgcgtaaccagacccgtgcctggctcttgagcttcatccaggtgatttcgttgttcggttcaaagacgctgaagcgcccgactttcatcagcttcgcttcgatataggacagcaggcgcctgatatgcacatagcgccacggcgagccgctgaccggtgtcaaggtacgacaaccccagatccggatccctcgtccaggaaaagcgcgtatcaggttgatcgaccccccatcattgttgaacagcccgtcggcgcccagatgggacaccgccggttgaaccacatgggccagttccacgttggccggcgctttccacaccccgtattggcagtctgtttgctggatgaccgccgccacagcggcgctcggtggcaggacaatggcgctaccgtctgcccatgtgtagtcgctttgcagacgtggccaatatgcagccccatgctcgctgcccgccagctcgccggttttcaggcacgccttggccgcttccaccgacacaggggaatccagcaggctgaacagccctgaacgaccctggcaggcctgaagcatggcctgccagaccgacatccaggtgtcagaatcggcctggtcatcgagcagtacgatatctggcagcaccaaaagcgaaatggtcggctcctgcataatgctcgaagacaaggccgcagcgcacagcgccttggcgacagccgccgggtcgcagccggtcagcgcctgataggtgtcgaccgaatacacaaagcagggtcgcccgccattatcaaagtaatgctggactgcataataaagaatcgagcccttgtcacccgtactgtccgggccacccagaagagctgagaaactatccatcgtctcaatataaatgacgcctttttctacgttgttttcggtataaccgataaacaccggaacggcgatctgttcttccgatatcggtagggtgaccatggattcggagaattcaactccagggtgcaacatgctcatcatgtcttcctatattggattgagtgcgagcttacgcacacggcagccctgatgttgttggcaaggatcactgagctgcaagccaaaacggcacgaagctgaccagcaacctgtcaacaacatcaatgaggcgatccgagcgcaccgataaacatcagtcattaaacaactgaatattcatgcagtgcgcacatgtcaaagtctgctgctgttacgaagcggcaccgacatcctgagaaagactcagaataatgaactcggcaggacgaactgcggccataccaatattgacaatcatcttgccttgtttgatatcgtcatcggtcatcgtgacgtccttgccgatctgcacgtaaaacgcttctttctcgctgttgcccatcaagccgccttcctgccacaacttgcgcaagtagttttcaacggccgagcgcacgcgctcccaggtcggctggctgttgggttcaaacaccgaaaacgccatggacttcttgatgtctttttcagcactgttgaacaggcgacgcaccggcacataacgccagtcgtccgagtcttgcagggtacgcgcgccccagatcaggacaccggagtcagtaaactggcgaatcatgttgatcgccatgcccttgttgtattgaccctgttcgaagtcgctgactttgtacttgggggtcacgctgccaaaaagagccacgttggcaggcgccttccagacgccgcggtcacgatccgtggcgcaataggcgccagcgaccgccgcgcttggcggaatgtcggtattgacgactttgccggtcgaatccatgctggtggcccagttggccgtcaaccatgggtagtaggcagccgcattcggggtcgggccataaggcgacacataagtggagtccagctcattgactgggccgtcgacgatggcgaacagggaattgcccacagcacaaagcgtggccaccgcatcgctgatgttttcgccagcggcgaccagcaaggtaatgtcatcgtactttggaacgtctcgcaccaggttctgcacctgagcgacgtagcaataaccgccaccattctcaaaataggtcttcagcgacacgtgcagggtattagtggggtcaaaggtacccaccttggtttcaaagtccagccaggaaatgatctggcgggtgataataaaattctcgtcgctgttcttcaccgcaaacaccggaatagcggtcgcgttggaagaaatggacattgagagactggccgtctcttcaacgtatacgccagggtacgaagtaacaatcgtcatgatgtcttcctcaaaaaatacagttcgaagtcaaattagtggaacttggtcgtcacggcgtcggccatcagactcagttcctcaatggcgacttcattgctgctggcatcaaaatttggggctgacagcttggttggaaaagcgttgctgatgttccaggtgaccagcagttcattgcccgaagcgttggtcaaactgatggaaatgtcctttttctcgacctggttcaacgaagtcgaactgatccagtcgtacaactggctctgcccaacgaccatgccacggcgcagcgtgatattaacgggggtcggttgccccggcatgcgatagacaccgccaacgccatccttgtatacgatggtttcatagccaatttccaatccggagactgcgctgaaggccatttcctgatcgcccaccgctactcggtagcggtacgtcggaatagggtaagtcgtcgcgatttgatccactgtagtagccattaagtttcctttcctcaagagagtgttattgcaattgcgtcgcctctgcccctgataccgcgcagtgatcatgaagttagtgataacaactgatcgttactaattagaaagaaccgtaccctgtagtacattcaatccaagcagaggagttacagactctagtcgcaagtctttcaggcttcaatgcattgtattttttcagacggcacattattaaactttgaaaaattgacttatagcgtctttatccgcgcgtcaaacagtgtatgaattcatacgttttattgccgactcttggctgagccaacctataatcgaaagtaactttatttcttcatgacctgcccgcacacggacaatgcccagggtgttgatcaatcctggcggcgatggttaaaaacctgaatatttttaagggaaactctatggatgcgaccacttctgcatcagaaaacgcgatgagtgaacacgataattatctgtatatggtcgagcatctcaaacgtattgataaggtattgcaacgctatctgtatgatcaggaggcaagccatgacgatccagcatcggaggataacgtcgagctatccgaatggctccagttgcgactggatacggccaacgctaccgaggacgcccccacgctggtcaactcccgcctggggcaactgaccgtgcagttttccttgagtgaccttgagcgggatatccttctgctcaccttgctccctcattttgatccgcaatattcctggcagttttccagcgcccaacgcaaccaggaactgcgctttcccagcgtgagtcttgtgttggatctgctcacaccgacgtttctggacaagctcaaatatgaggcgctgtttctgcctgacgcgcggttgcgcaagtatcaattgatctgtctggaagcgttgaaggagcacgatcgcagttttaccttggtcaaggctgatcttgcgctttaccactatctgatcggtcacgattacctgcctgcccaattggcatcctgtgctcactgggccgacctgcaggaacctgtgagtcataccgtacaggtatttggccgacagttaagccgctcattggccttgcccccgggcagatccgcgcctcgcattacattaaaggggaccgtgggtagcccctcggtgcaggccgtcacggcggctgccaagctgttgggcatgccatgtctggtgctggatctggagatgctggccgccaacgaggaggaagccttacaggcgatcggactggccttgcgggaagttcagcttcgcaatggctgcctgctgctgcaaggcctgtcatccctggaggcatcacgtaaacggattcattcgttgctggggcaaaaagccagaatctgcccgcagcctctgatcatccttcaggacagcgcgcagccggttgctcggctgagtgacaccgcgcacctcgtattggaaatgccgcaggcctcgccgggcgattgcctgaatacactgcgcgatcttctggatcccaatgtgttggacaaacaggtcgatctggcgaccctgtccactcgcttctgcctctcccccgctacgttggtcaacaccctggaagaggcgcagttatatcgccgtcaacgtgatccggctgccctgctggagcaacgcgatctggtgaatgccttcaagcagtgctcgcaacagaactttggcgatctggccttgcgtatcgaccccaagcgcacgctgaccgatttgatggtgcctgacgatgtgcaaaggcaactcaacgaagtgctgatggccatccgtcaccgtgagcaagccgtccagcaggggtttggccagaaactcaactacggactgggcgtcagtgcgctgttgcatggcccgtcgggggcgggcaagaccatggcagccgaggtgctggcttcggcgctgaatgttgacctgatcaaggttgacctgtccaccgtggtcaacaaatacgtaggtgaaacagaaaaacatctggccaagatttttgatctggcggcgcgagacagtggcgtgttgtttttcgacgaggccgatgccttgtttggcaaacgcagcgaaaccaaggatgcccaggaccgttacgccaatatcgaggtgtcctaccttctgcaacgcctggagaatcattccggtctggtcattctctccaccaacaacctgtcgcacctggacaacgcgttcacccggcgcttcaccttcatcatcaaatttgtgcttcccgatatcgcgacccgcgccaggctgtggcaaggcgcctggcccaaaggcattcgagtcgccaaggacgttgatttccatgagctggcacgcgttgccgaagtatccggcgccaatatcagcaacattgccctgctggcgacctggctggcatttgaagaagcggccagcgaaatcagcctcaaacacatccgccatgccttgcggcgtgaaatgacaaagaccgggcaaatcgccttccaataaggagaacatgatgatcacatccgacaccgcggtaatcactcttaaccagcaacttgagcaagcgatccaggcgtacgtgcctgctggcatcgaactcgatttcaacattcctacggccgaggtcacgccggcctcccccaccatcaatatctttctctacagcgtccaggaggatctggccctgcgttcgtcggtgtctcgcaactacgtaccgaccaccggcaatctggatccagcctatgtcaacattcgttgtgattacctgatcacctactgggatgccacggcctgcaccaacgtatcggccgccgacagccaatcgatgcaggtcatgaactgtgtcttgaatgccctgatcaacacccgtgaaatcagcggcattcccaactcttacactcgagtcatctcgccttcggaactgcatgggttgagtaccttctggcaggcgctggggaacaagcccaggttgtgtctgaattacagtgccacagtgcctgttcagctcaccaacaaccatgacaacatcacagctgtcggtaccctggatacttcgttcgagaacctcgacagcagcgcgggataaccgagtcgaaagcatgttgctggtgacaggatgagtccggtgtcgagacgccaaaaggcagactcgcgcatttaacaggcgctggcttcgagacgggctcgatcttgtaacgaccagggcgatgaatacggggggctctgaggacgcgatcaaatggatgtgttccccgtgacaagcaccgacgataccggcccgtggctcgcgctgtctgagccaacacgcacctgacttgtaatcagtaggtcccggggtcgactcctggtgccggcaccatatagcaaagccccgcaatgcggggctttgctgtttctgggacttgttcaagtccctgcttcacttcttcgaaacgtccacagagtgtccacacccagccgccaaagggttgagattgaccacttccgcaaggtggccagggctgaagtgggcgtacttcatcgtcatcgcctacgaggcatgccctagcacccgttgcaaagtcaggatatccccgccgttcatcatgtagtgactggcaaaggtatggcgtaacacatgggtcaactggccaactggcagatccaatgccaccgcatcaacggactcgccaaacttcttatagcaatcaccaaagggcatcgcctttttgatttgcttctgcaactcttcagaaatcggtacagctcgattctttgacgacttcgtgcgagtgaagtgaatgcggcaatcacggacctcgggcagtgagactttcggcttctgaccaccgagccgacatgaagctgcacaaggtattggccatcaatggcgcgccgatcgccctggtgaaagaggatgttcggttggatgcgaccagtcccggtcgggcgacgttcaccatccaatccgcggtgccggtgaaaggcctggtgacgctggatatcggctacaacgaaggcacgttgcaacggcacttcattggctacgtcgagcgctgcaccgccgccaacgccgtcgagcaggtgctgttctgccgcgagctggccgccgtcctggccaccccgctgccgctgaacctgcgtcacgtcgacctgcgcgccgtgctggccgagatcagcgagcagaccggtttgcgctttcgtgtgcccgatcgggcctacgccggtgttaaggcgccgttcttctacagcctggccgccggttatcaggcgatggacagtctggcccgggtgttcaacattcccgacttcacctggcaccaactgggcaacggtgaagtgtttgccggcagttgggccgacagtttttttggcgcacggtcgccgctacaaatccccacggagcttttcgacggctaccagggcaaccaaagcgcgatgatcgcggcccttcccgggttgcggccaggtgcaacgatcaaccacggcgagcgcatcaccagtgtggcccttgccaatgaccagatggccatccgatggaagacgcaatccgccgcgctgtagagcgccaattccccgaactcaccggtggttaccacctgccgcgctttgcccgggttgttgccgtggccgatgcaccggccggcgccgggatctgcgacgacttccggccgcgctttgccgtggacatcaaagttctcggcccggatggcgagcccgatccgcaactgccccagctcgccggcgtgccgctgcccaccggtggcgagaaaatgggcctgtatgcctttccggaggaaggcacccaagtggtggtgtgcttcgcctatggcctgccgaacaagccctacatccagacaatcctgccccacggcctgagcatgcccaaggtgccgaaaggcgatcaggtgtggcagcacagcgaggcggctcagcagcgcgtcgatgccgatggcaactggttgcgccagaccgatggcaagatccaggacaaggcgatcgagcgcgaagtggaagccctggataaccaggagcggttccagagccacacgcgctcggtcgatgaccactcgactgagtccgtgggcggcatcaagaagatcgaggcgctgagcgcgctcaagctgctgtcgggtggatccgcgagcctggcggcggtggatgatttgcaccaggcgaccggccgggatttgaacctggtggtggggcagacacacaacgccacggtgggcggggatatgcaggaacggattgaaggcttgcgtcagagcgtggcgggagtcagccagcgcatgcaagcgcccaaaacgtggctgggaactgaaagtatcaacgtgctgcaggtgatatgcgatctgctcgatctcgtcgagcagatgagcacacaactggcaagccatacccatggacaaacactgccaccatccaatgccgcagcgttcagcatagccgcagcaagcgccaaaggaatgcttggaatgatgaagccaattacgcaatagttgatttcgttacctttggctcaatgaatgcttaatagttgcttgccgttcccatctctcgcacccggtcagagcgactgcctacggaggtctgaactcggactttatattgcaagcatcgcaagcttaggtataaatacaaactacatgggcaggtttgtagtcctggagcttccgttagtcgcttagcagtaaatgggaagccatttttgaatagcaccgaaaaagatcttgctggaacataacgcacatgttgcacaagcaagatttataagtgtttacgcaaaaaatttcgatcaagtcaattgacggtgattcgccgatatttgttgtgctggcaatgaccgaaatctgccatacgtaaagatatggaatgcatcctaatgctcctacagtatcccatattttagtctgggaaaagattatttttgcctgatttttctgaaatacaacagcgctgctagtcgtagccagctgacggcttatccgagagctaataaacctacatgtgtcaatggttatccaatgatcggagtcacctacttattgccaagcccaaaggagtggaaaaacaataagactgaaaataattcctataaaaaataactctgtaatatttggtcggcgctttattaaactacaatcgagcatggaagaataaatgtctagctacgtacaaggctccatcccgcaacgaattacaaatctgctgcaagaagttggacttgctaatagctcaataattggcgcattcataacacaggttaataactcagtagagggaattccgtcgactgagcgagatgtccatgaactgctacgcctcatcgatggtgtttctttttttattgaaaatcaaagcttcgaatctgcccaaacctaccgtccgctgcttgatggactgtggagcattgcggacggcctgtccgatacttacggtcaatccagcgtaagccgatacaagcggacgttattgactggaagcacgtcgcgaccacctttggagaccgaaaccaccgaagcgacgactacaccgtcaacggatcagctctccgcggagcgcaccttgcagctgctcgcaacgctcgatagtcctattttgaatcccgcggtgtttattgatgattacatcacgacaggtattcgtcgctacgagcaacaaagccgcacgacttcttatttgtcaccggacagctatgtaactgtgacttaccatcccggcccctacgacccgactctgataccctctcgtgcaaaggcgccgagcagcagcacggtacgcgcaacgcttcgggaggtcgtgacggggcattatttatatgctttcaagcaagcgagggattcgctgggccgtcagtactcgtatcccctaaccacttttgagccgagtgagctaatcgaatcactgactcgggaaaatctgcaaaccgtgttggaacgcgagttgtcggtgtatcgcgacaaccccgccaaccgaaccgggttgacggcgctttatcagaacatgatacagctgcgctgtttcgaatatctggacagtccaaacaaggacgttgaatatgtacctgcggtggaaaactttctagccggagacattcaggctcaggaagtgtcctttaaaggagctaagctgaatggagtattcttggtacccttgggccataaaggcggtgtgcttttcgacgtggatgcccccggtttttttcatgtgattagcgggacgcgtacctatgcgatgcttatggcgggaaggcggaccgaatcagtctcggtttttcctaataccactgaatttaaagactggcttctcgccaagctacccagtgttacagcgctgcagtataaagacagcccggtttcagtattccgtaccacggtcataccagatataaatactatgccgccaggtgtgaagctggcgcaccctttttcttttactgcgagccaaaaccaaggcgatctggccaataaactatttgatggtctgatgaatcgtctcgattcggacatcgattacctggtgttcagttcttgggagcaaatcaccggacacttgctggaggtggccaagacaattctgacgatggccgctattggtttgaacgccgtcattcccggtacaggggctgtgttgggccgtatcggattgttcttggccaacctcgcattggacggtgcttacgtagctgccagcttgacgcaagcgcacatggccgacagaccggaagatgccgcagcgttccgcaatgatgcgatccttggcggcatagtgggcggtgtggttactcttgcgagcgcagcgcccttgaccaggcaaggcatcaccaaggcccttgccctttatcgtcggaccaagtcagccacacatacatttattccccaggcgttgcgcgcagtgacctggtccagactggccgatgacgtcaaagtcaatctcttggttgatagcatgaagggcagcgagcccgcgcgtaatttggcgctcttgaccactccggaaatcgtcgagcactcgatacgccagaatttgctattggattccctgggtactgcaaggactcgtttcgcctggggtgaacttgcatttgaacaagctcaggttcagcgccggctgcagtcagacctggcacggttgagcgcggcgaatggtcacattcgtggactcctggacgcgccacccgcagtaccccgccaatccttgccaggagaaccagaactggctgccgcgaactggatcacgggcaatagccgctccgccgccgacccagggtcggttagcgagttgcaggggcgtatccggaatgtgctttcacagaatcgccaggccgatctgttggatatccacaccatcaatcgcgtgcacgatgcggtataccaaccagtagcaggacaagtagagcgggtgttccgctcaagtagcgatccgctgttcatgggctcggatgtgggtcgcgccggttttgtgaaaacgctggacgatatcaaaatcaaggtgcaggcaggacacgtggacgcgggcgaagcgctctttggcgccattgtccgttaccatccctatggtgatggcaacggtcgaaccgcacgcaccctttatgcgctggcgcaactgaataaacaagagtcatctttcaaggccttgaccccactggctgaagacatgctcagtagccttcctccaaggggattgaccgctggctgagagatgctcagtccatcgatgcgccgcatcaccttctaagtcaccagcaatcgaggcacggcgtgtgatttgtcacacgccgttcgctgttgtattgctagaaatgagatcgatgctcaagtggatgatgttgcgccgtacatgcggttccgcatacggcggttcaattaatacaatggagtcgctgcacagtgctacgcaacgagaccagcccccatttggcgaagtacaacatcggtactgcctgattcatgtgatgggatgccgagttccaccaagacccctagtccattaacgcccgattgccacgctcgctcggatctaagcccaagtgagatgaggctcgcgggtcttcgggattttccactgtggccagagcagacaacgcaattttcgacgcagccaccatccatctgccaccaacagatcgatcacttctctacttcacatcctgtcccccctttgctccataggcggaacgcaaagcgaatgcataccatacaatacacacgaacgcatgtactcagcaaaaccttgcctgacacaaaaaagtcgctgaaaaagcacttatccccctcccgccgacgggctttgcgtccgttttttgtgcaaatcccgatgcagtgcaaacgaacctgcagcccaggcgggccgtggggctatgcgggggactggccatttcattttgtgcaaggttttgaaaggaaatgcagcgcggttgcacagcgacgcagcgggcgctcacggaagaggtaacgctggaggccccggtgaagtatcagcagcttcgacgagcaacattccgcctcctaagccacatcaaaaacatcggtggccatcttttttacactggcgaacacaaaaccaccgatcctgtcgcacacgactcgacaacgacattcaaacgtcagctgctccaatcggtacgcaaaattgaccggttctgcgctcagagcgaatctacattcatcttagtgctcgatgagcagaaggccggcaacgagtggcgagaaaagaacgtggaggcatgcacgctggccatgttcgaagatgcctcagaaaaatgcaggacgatgatcgaaccaccgctccaaggagaaagctacctgtttcagacgctccaatgcgccgattggatctgcggtttgatcggtcgattgactgcgttagccgtggctcccgaggagttccaggactgggaacccttcgacaaatatttctcatctcgaatagccttggtaggcgagccgcaataacgaagcggacgtgaaacccgatcccttgtggtctcttccctagaaattgatgtcgattgaaaacgcttcgcatagctgcaacccagatggttcaagggttgcagtggttttctactgagaagaataaacaacctaaaagtcatcctgctcaatccctcagaaaatcaaaacctatccgaaatcgatttttttgactgtgccccctacaaaccgggctattactttttgctgccgccttgttagtactccccgaatttgtgcagaagcatttcaattctttgcaaaactttgcactccgcgcaattgccgaaatcctctcaccgcccgcagcaggcttaggcggagctatggttttcaccacacccatgttttgcacaaagaagggacacaaagcccgccggcgggagggggataagtgcttttttcatctgtttttctgccctagtgttttttttgttgcgcagcatgaaaatgctccctgtccgataggccaggctcgccgatccgcccgacagcaacttgagcgcgcccagggcttccactgtcttcacaccacccacggactcagtcgagtggtcatcgaccgagcgcgtgtggctctggaaccgctcctggttatccagggcttccacttcgcgctcgatcgccttgtcctggatcttgccatcggtctggcgcaaccagttgccatcggcatcgacgcgctgctgagccgcctcgctgtgctgccacacctgatcgcctttcggcaccttgggcatgctcaggccgtggggcaggattgtctggatgtagggcttgttcggcaggccataggcgaagcacaccacgacctgggtgccttcctccggaaaggcatacatgcccatttcttcgccaccggtgggcagcgggagcggcacgccggcgagttggggcagctgcggatcgggctcgccatcggggccgagaactttgatgtccacggcatagcgcggccggaagtcgtcgcagatcccggtgccggcgggcgcatcggccacggcgacaacccgggcgaagcgcggcaggtggtaaccaccggtgagttcggggaattggcgctctacagcgcggcggattgcgtcttccatcggatggccatctggtcattggcaagggccatactggtgatgcgctcgccgtggttgatcgttgcacctggccgcaacccgggaagggccgcgatcatcgcgctttggttgccctggtagccgtcgaaaagctccgtgggatttgtagcggcgaccgtgcgccaaaaaactgtcggcccaactgccggtaaacacttcaccgttgccctgctgctgccagatgatatgttctcttgcattccaccgcccaacgtcgcgctgtgcttctgaccacaatgaggttcagatgccgcccagtcacctgatgcagatagtcccccgaccgcagcttgagcacgtccagcacgggtaaagctaccccggtgctccccatcgtcgaccagactgcggaccaaggcacgccatccaaagcagcgcacgcgctccgtgatcgacgcagcgtactgcaggggggcataaccgtgagttcgtggaagtgaatacgacgccgggcattgcggcgcctgtcaggtgcaagcaacgccgactcccacgacagaacgtgggtgactggcgaggaatgaacccggaggctgccctgtacctggccagcgtcatggggcaggcttacctttgccaataccaccgctgcctcccttatcgcccccgcggaaaaactgcacgcgactacgtcgctatatgtatcgaccagcgtaccggcgatacactcgccctcctcccccgcgtgtctggcaagactgcaccgtgcgtgtagagacagcgatggaggcagacctatcgcccgaaacagcgtaagcggttcaattcataaatgtagagacacagtgcgtcgaccatatgcccggtcaatacttcgtagttgaggatggtgccgggaatcgtggcatattgatattgctcaatggcttcaggactgtcctttttttgtgctgtgggttcaggttcgctggcatggacgcttttcacttccaactggccaccggtgccatccgttttaacaatattgctgtaaatgactttattctgcgaaaaaccgtcgcgcggttgagcgcgtatcgtcaatgtaatggatcgcggattgacgatcacatagtccatcgtgtcatgggcagccgtcgtatcccccctatcgttatgcacggtggtgtaatactcacgatgatcctggggcgaaaccttgggcaacagaatgaccagcccacaggccagaagagtcgctccccagatcaaccacggtaaaattaccgtcaatacgaatcttaaagtgatttttccaggcatttttgagtcgcctctgaaagagtggttttatcaatcgaaaagctcaggttgtaggtgcttttatccaagcggatgcacgacatgctgtagccttccttgttttgcaaaagccacacttcacccgtgagcgagctgggaagcttttcaatctcgtgctcggcctcttttttgaaatcccacgcctggctcagtgtcgccgccataaaattcagggtgaggttgttggatttcagttgggaaatttgtattttcgaactgtcgaagctgaccacatggtcgatcgccaataccaccagtggcacaagggctgcataccccaacacgatatttttggcgcggctgaattctctgatggccgccagcggcttgcgcttgttttccaggacggatagatcgggcgtcatcaccggtgcgtcgaacagagagctttcttcggtcgccactggcagctgatcaagctccggaaccacccggctttgattaaagcgatacccacgtctagggacggtgatcaatatttcatggtcgatattgtcgtccagaatatttcgaagcgaaaaaatggcctggttcaggctgcctggaccaaccacgcggtcatcccacacatattcgataatttcattacggctcttgatgtcgcctgcggcactgagcaagaaaaaaagcagtcgcgattccgtcctgcccaaggtgagatggttgacggaattgtcgggaagagtaattgacaacataaagttgtcattgctaaaagacgctaacttgccatgctttagtctgaatacaaaacacatgacgaacactccgctgaaataaaccttattcactaccattcacgcgcgagctgaccgcgcagccagcgccctatgaagtgcgaccaatgacgaccttaaatgctgcgcagtggaatcaggcgcggcgttcgaaagactaaagatgtgctattggcaggctcccgcgtttttctgttcagttatatgcgatttaacacctgtgctcgcacactagctgtagggcaatccttcagaatcaataattgttattttttcttgcgcagttttccgcccatccgccgcctacactgtgggcactttctggttcgaacgatcgatgacgtacagctcgcccagccgctgtgggccgatctaaaggccggcggataatccctatccaggcctgtactgaagtgcgaaccgacgacgcgcttgcctaccacaccttccatctgaagctggcaaatgttgtcgagaaggtggtacgggtcgacgtccagcgtctcggaaaagcgcacccggtcgagtgcacagagagctagcagctcgctcagcaactggcggcgctgttcgacgggccgagggcgcaagtcgatgccattgatccacaacaaatcgaaggcgaagtacacaatggcatcggtcttgcccgaactgaatgccacttgcagtggctggaaagtgggacgaccttcgtcgtcctggaggaccacctcgccgtcgatccatgcggactcgacgggcagttgttgcaggtcgcgagccagctgcggcatgcggcgcgtccagtcgtagccgttacgcgtaaacagcctgacatccgactcgatccgggccagcatgcgataaccatcgaacttgatttcatagcgccagtcgtcgccgctcggcggacggctggccatggtcagcagttgtggctggatacgctcggggcaggggatggcgacttttcgagagctcatcacagaagcctcttcgacaacggcatattctgtggattcttcaaaacaccgaaaggtcagggaaaattctacaggcagtcgcaactatcgcaatttatgaagtctcccgggaagcggtgctagccagaatcacagcaccggggtccaaggcccgcaacgaacgaggttcactaggtattccacagtttaatccatcgcgactttgcgctggagacgtagtgaaccgtagatggccatctcctgaatgaaatccgatgggcctggtaggcacggattacgagttctgctctttgccctggttcagtgtttgccgataggtcgattccacctcggaatcaagctcgccggcgtgtgagctcgatgtgtcactatcaggaagaaaaagacggccgctgggtagggcttcacggcgcaacttattatcagggcgttttgcggtgcgagtgcgactgtcaaaactcttgagctcaacaatttttggtggagcagagccttggagaacaaacactggaaggttcgcatgaactgaatcgccccgggtttcgtggaggcctcaactcttgagaagatgaggccatgagaaagactacgacctattcccctgaagtccgtgaacgtgccgtgcgcatggttctggagcacctgaacgactacccgtccgagtgggcggccattgaggccattgccccgaagatcggctgtgcagcgcaaacgttgcatggctggattcgccgtcatccaaccgatgccggtcagcgtccggggccgaccaccgaagagcgcgagcgcatcaaggctctggagcgtgagaaccgcgaactgcgcaaagccaacgagatcctgcgtctggccagtgcgtattttgcccaggcggaactcgaccgccgtaccaagtcctgagggcctttgtcgaccagtaccgtgaccgtctcggggtcgagtcgatctgccgtgttttgcagatcgccccgtccggttaccgcaggcatgcggcccaacagcgagagggcattgggatcgccagatgcacggtggagcggctaatgcggcaggcgggattgcagggtataaggcgcggacaggttgtgcggacgacggtggccagcgacaaatcgctgtgtccactggatcgtgttcaacgccagttccatgccgaccgtccgaaccagctctgggtctcggactttacctatgtctcgacctggcaagggtggctgtacgtggcgttcgtgattgacgtctttgcgcggcgcatcgtcggctggcgagtcagtaccagcatgaagaccgacttcgtactggatgccctggagcaagccctgtatgcccgccagccacaccgtgccgatggactgattcatcacagcgaccgtggcagccagtacgtctctattcgctacaccgagcggctggcagaggcggcattgagccctcggttggcagcaagggtgacagctacgacaatgccttggccgaaaccatcaacgggctgtacaaggccgagctgatttaccgtcaatcatggaagagccgcgaagctgttgagatggcgactttgaaatgggtgcactggtacaaccaccaacgcctgctgagctcaatcggatatatcccgcccgcggaggctgaggcaaactttcaccagcaacaagcaggtcaggccatggcggcctgacttaaacgaaacggcctccacaaaagccggggcgattcagatgtagtcacgcttcatggtcttcacgaagctctcggccatgccgttgctctgcggactgcacaccggagttgtcagcggcagcaggccgatctgccgggcaaaggcgagggtctgccggatcacgcgcccccggttacgggttgggatgcttgtacacggctttagtcagtgtctatgggtcgcagggacactacctagggtcagggaaccataacttcacccctgagccataacttttagatgccccctctcctagcggagttataatcaaccccaggtactcatcaggatcattttctatacgcgcccctgtgggcacagactcaggatgtgggcctacagttaccatcgttcctgcgggcgcgatcagtggcttccgtaagggcaatgtttccttagagtgatagctagtaacaggcggaacaggcggcgcactcggccccctgtatctaaagctctcgtcgtttctgctatagcaatacccgagaataacatgtttgcccttatcggcaatcaaacgcctatgatcttcttccgtcaaatcctttgcgtcataaatcctgatccggctctcgaaacttttctttgttgccgagctggaaatgtaatagccggggcggcccttcgagcccggtataaacgtgtaaccgctcagatcgcctgaaacttcaggccccgttagtccgccattagcaggaccctcagttgcccctctcgtattcggaacgaaactgccaccaagatgacgtactatgtcttcggacaaaaaacttttataaagaatttcagggatgcgttcccccgtactctcctcccaattatttccactcggacggccatgagtacctgatacaatagcaatggggcgtttggtaacgctgtttcttcttttaagaacgtccaatggcttggtactatccaccgccccatcgctaagctctgggccagtgatcggcctatcagccccccatgtatatttgtgcgccttcaagttgaaaatatgggggcttggttggcgctccgagtgccaaaagtcgactccgccgggccgttgaaactcaaacgccacgggtggcttagccaagagggtgttaccatgggatgctccaccaagatagtttgggcctcttcctgccggtgcggttccggggcgagcatatccggatgaagtggtaccccgccaatccaacgaagcctgtccgaccagtgaactatccattggcctggaatcaagctgagcgctgagatcggtatcactggaattgcttataaaaagtttaggtcttcccatcacatccaccgattgattttagatacttgatttggcgatagccatttacctctaccatcaccgtccttaattgctaaggacacatctgttcaaaatgtgcgtacaagaggggcattccaacgcagcgcgcagcacttctacactgtcttgaaagcggctcgccttaataatcttttataaaaaattacgctgagcgagagaagcaaatgtctgaaatcgtagttttatatacgcttcagacgataatagtcagttgcgcccgattcacattgaaactataaaaaacgaaacgagcttgcaatgtcctcgattactactcactaatgagcgctggtcgacgctgcgaaaaaatctgctgcataagaccatctacaacaagcatgatctgtggatgcccccggtactgagactgaaactagattttcgtgagctgcagcacgagcagaacctgagtagcgcttttgcgttgacgactgactacccatgaacgacggcaaaaaagacaggcgccgattctggtcggtgtctttcgtttgatccattccacccagcacaattaattctcccagctgtgctgaatttttttcatctcccgccgcccatcgctttcgtttatgatccattatgggatccccaaaaatcgattcaatttcctaaccatgaaccaaacaggcttatgacgcgttaggaagtgaaagttcggttttaccaaacgttctgtcataaacttccagaatttttactggtgcactcttgttaaccacaaagcctgattcactattgcttcctgcagcaagatagcgttgttttattttagcaacaacaccatagcgccctcttgaaaacctatcaaagacagaactatctgtgctaaattctggcaaaaatgcgcctttgcctacttgttttttgctctcgccttcagatggtgcgggggtttctatatcaatgttatcgcctgcagacttgttattaagcatgttaacaacactcatgccactggtccccctatacaaaatgtattcttcatctggattgcgcctctcagaaattttattacggagaagaccgtaatcaagagttttgtattcatcgtccaattctttaggcaggggaccgtcatcatgttcatcatctatataatcgtcatcgctttcatctaactggctataggctggaacctttttggctatttttttcatagattcaatagtatacatattatacctcttaatcataaggttcgagatagccgtatttagactagccccatgagtactcagacaggtcacatcactttttaagtaatggttttatgttcttaatggtcagtgtgttgacaccatgataactacttatgttctacggcgtaaaggtattgatacattaattcgaaaggtgtcgtatggtacgatgccagcatgagctcccatctcaacttccgctttcagtttctcttgaccgagtccagttagtcgtcaggatacacacccattcattgggtctcgaggcaaacggccaattttggccagttctcttttcatcgcctgttctatatgttgaatgccaatgtcaggggcacgttcatctaccgctaaccacgtcgccagtaaggcaatattgcggatattggcgcccgtcagctcggcccgcatagccaggcgtgtaaagtccacttcactggcgaggttcaacggttcgggccaaatgctgcgccacatacgctcgcgcaaagcgacgtccggaaaagggaagcgagtgatgaaggtcagccgacgactaaaggcatcgtccagatgactacgattgttggtcgacaaaatgaccagccccgggtagttttccaggcgttgcaacaggtaagacacttcaatatttgcgtgccggtcctgagcatctttaacgacactgcgtttgccaaataacgcatcggcctcgtcaaaaaacagcaccccggcatccgcttctgccagatcaaaaatccgcgagaggttcttttcggtttcgccgatgtatttgctcacgaccgtggcgagatcgatttggatcaaatctactcccagctgctgggcaattacctcggctgccatggttttgccggtgccggaatcgccataaaacagtgcactgatgccggtaccgtagccaatcttatcgctgaatccatttttcagcacagggtcgcgctgccgggtggcgatcaggatttctgtgagctgttggtacaactcagcatcgacaatcagattctcgaacgttcgcctgggctcaatacggcgtgccaatttgccgaagttctgctgtgagcgcagccggaacgctttgcgcagatcgacctcgctgagcggtgagcccggatcgcgcagcttttgatagagttccgcttccttgagaatctgcggcagcgtttttgcagtgaacgacaagcgccgacagagcgccggcacatcaatgtgactcgtggtgaatgccctcagagaacgacataacagcgcctctttctcggtaatatccagcgtgggcatgtcgacaaccagttgctcgagatgaggcagccataccatgggctcccgccgctcacacaaacacaccacgtgtaagcccggttgattcagctgttgggcgaatattggcagcaactccgagagttcttcggttaacaactcaattgagcgaaccaccaaacatgccgcccacatgcgcgcctgacgtaaaacctgggtaagcacgagttgggcatccatattattcgtgggcaagcgggccaaatcgagttgcagtgtttcaccgttcatgatcatcatggcataggtgatcgccatcgcccgcccgctatctgcctctccgcgtaacatcatgacggggcgcacttgcccatcgtcaacggtgagctgagtcgccacgcctgctgtcacaacagagggacagccatgttccgggctattcaacaccgacagccattcagcacagcccaacagcgaggccggtagatgctgctgcccggtcagataataatatacgctacgatcagtcaaaaatgcggtttggctcaaggcctgctgctcgtcctttttaccgagacagagcagttgatgctttaatagtggtgattgagctattaaacttgtctcctggaagatcttttccatggggcatgagcaaaacaaggttaacgccaattcaaaattaaggtttttttttgctgcgcctgctgtaatgcggaaaatagggtgacataccgttgatcaaagtgaggcagcagtcctaatagcaggacatctttctcaaattcggttaaattaaaacgtctgcccaattgatcgagcaacgtacaattactgacttcgcatgtaggtatattggcagcaaacttgacacttgaggtataccaatgcgggacaccttgcggagtcaatagacgagcgtcaatttcctctggcgaaagtataaaatcctccagtatatgattgtcctgctcttgcaacatctgaagcgcacgctgctgtagcattaggtcaatgcgttccagctgactaagcagctgatcaatacgatggtctacccggagggggggggcgtctatcgagggtgttacgaactgattcatcaacagcaccatcctttccagtgagagggactagtccagagagcctagtcatatatctcggttgtaatgcgtaaaaatacgaaaagctcgtcaatagaaactgcagcgatagcaccgactgttatgtaataatgactttagttcattgtacccagtagcgaatgatcaataagtcacaaacagaacattcaagattaagcgacgagtggtttttcccagcgcacggacagcagcatcgagaacgagggtaacatcaatatctctatcgggcacaaccacttacttactagtggcctaagcagttaatttattcatctattggtaacgatatactatgcgtccaatgtcatggattggttatgcgcatgggccgaccgacttccttcttcgctttaacgccatctgatctcatcagccctgcaaggttggttgcgtatgcgctactggcacactcctgacctaccagtaaatactggcaaagccgagacacgtttgcacactgccgccgcatggatcaatcccaacgcattgcattgcacttctatactgctttaaaaacctcctcttgccttgctaatcatttatagagcattaggttgagagagacaagcaaaggtctggaatcgtagttatatatttccagtgataagaggagcctacagaattcggaaaaaatccgtactacaagggcctcgctaagagggtgtagacaaaatcaattaacatgcctcgaaccggacgcccgcctacgattattcctgagcattacccactgctggtcaagctagcccacgctcatcccttttccagccaagctgagttggcgaatgcattcctcgctgaaactggtatcagtgctcatcccgacacgtttgcaaaagcgttgaaacaggcgggcatcacgcgggtaaagtagcgcgccaagggtagcttccaatcacccgaacctcgcaagtcctatggctacaacgaaacgcaccggcgtcagttgccggaacaacgatatcccagcggcttgaccgatgctgaatgggcactggtcgccgatctgtttggaacccagagaggtcgtggtgtgccacctcgccattctcgacggacgctgctggaggcctgctgctatgtcgtgcgcacggggtgctcatggcggatgctgcctcgcgagttccctcattgggacaatgtttacaagacctttcggcggtggagtgaccagggcaaattcgagcaaatgcatgatcgcttgcgtacgcaatggcgggacagagaagatcgcgatgacaatccgtcagcggctatctgaagggaagctccacatatgggatggaccttcgaaaatagggcatctcggatacatcgtctataagtgcatggatggatcaccgatcatcatcgggattgcgcaacggccgcagctcgcctcgggcgacctcttctggcaccgcaaaggagtagcgccccagcatgttcatgtgctcgtagatcagcggcgacagccgagctagatcctcttccagcaccggatagccgtactgctttagccgttccacggctgccgtcatgtagagggtgttccacagcactatgatgttcaccaccaggcccaaggcaccgagttgatcctcttgaccttcgcggtagcgctggcgaagctcacctcgtttgccatggaacacggcgcgagccatgctatgccggccttcgccgcgattcagttgagtcagggtagcccggcgcttggattcgtcgtcaacgtaagtcagcgtgtgtagggtcttttcgatccgcccgaactcagccagcgcctgggctaggcgggtcggacgatctccagtttgcagcgtgcgcatgatgcccgtcgccggcacgcggccgagtttgagtgagccagccaaacgcagcaggtcgtcccagtgttcggcgatcaggtccagtttgaccgactggcgggccaggccgttgagtttgccgtaatccgcctctggccgtgtgcgccagaagcgggtgccaccgacatcggccaggcgcgggcaaaagtgataaccgagcaggcggaataacccgaacaccacatcactgtaggcaccggtatcggtcatgatctgcgtcgactgtaactcggtctgttgttccagcacgactgctagcaataccaggctgtcgcgcagggtgccgggcacagtgatggcgttcaggccggagaactggtcggagatcaggttgtaccaggtgacgccccggccggtgccgaaatacttagggttaggaccggcatgcaccgtgcgcaccggtacgacgaagcgcatgccatcggcggaagcgacctcgccgccaccccagacctgggccagctccagttggctctgtgcggcgaccaagatggcgttggcggcagacagggtgtcgtcgcggatgtagttctggctgacccaagacagccggtcgcggcgcagggccggattgtcgctgcggatcagcggctccaagcccgtattgcaggcaccacctagcagcaccgcgcagaggctggtgaccaggttgtcggcccgcgcattgcgttcggacacatgggtgaacgcctcggcgaagccggtacgggcggcgatctccagaaggatttccggtagatcgacacgcggcatcaggtcggccacggccgcccgcagttgcagcagcgaattcggctcctccagtttgtccagcgcgccgatcgacagctcggttttgccctcggcgctctcgctcagttggattgcggggttgtcgggcaggcgggctgccaccacctgccaggtcgcatccaactcggcgctcagtgcatccaaggtggtgccggcatcaatggtcaggcccagcgagcggcagatgatcggccgcgccgccaaccattcggcaccggcaagccgagacggggatcggcatagcgccaactgggcgagacgaacacgtcgcgccggcgcagggccgtgcgcagcgcatcgagtgcgcagaacacataggcacccatgtcgagggagccatccttgcgggtaatgtgcttctgccaagccttggccacgatctcctgcggggcgtcatcctccggtttccgacgcggcaaattcagcagcaaccagtcgaggctggcggccacacccttgcccgccgggctaaagccaaaatggatgtgcttgagcaggtcgggcaggaagcggcgcacgctgcggtagcgtgcttcaagcgcaaggaaatacacgtcatcgacggggcggatcagcgcattgacctcttccagggctttctccagggtgcccctcggcaggtcgttgaacagccgggcgcgcacgttgtcatcgctgatcgtgttgtccagcacaaccttgcaggcggcggcgagcgtcgctgccgagcgatccagatctttcaggctacgcatacgcgccttcttatcggccttctccgcgttgctgaataggtcgcgcaacaaggcctccaaaacttccagtgcatcgtcatgcgcggtggcctccaggcacagggcgaaggccaccagcgttaccatccggcgcgacgccggcagccgattgatcgcggagaccttagccaggggtgcctacagaattcggaaaaaatcgtacgctaaggttttccgaagttgtaggctcgccagtttgatgcgttccgttccgggcccagccataacctatcggtcttcgcgggtgtgccacaggcgcaacaggtagatagtggaatccactatctcgtaacgcatctcgtattggccgatctgaattctgcgtacgtcccttggctcgaactcttccagacattcgccaatacgcgggttggtcagcagcgtggtaggtgcggctgtgagttgctgcactgttcgtgcggcggcaggctgattcaccgaggccagaaactcgtacagtcgggtaatgtcggaaaccgccttgcttgtccacttcaattccatcagcgcggcaccggcaacggagtgtcggtgctgagaccgtcagcccaggcctggacggtttggtggtcaataacgctgccagcgtcaacatcagccaaggcctcacgggtcaggcgactacgctcttcttcctggtctatccaagcggacagagcctgcttgacgatccagtttttggagcgctccagacgctctgccatcaaatcgaccttttgggccagttgttcagggacgtgggccgtgacagatcgggttttcgcggtggttgccatgatgagggttgctcctgatcgctacttcttgaatttgatgtcgccggatccggcaacggtatgatcgcggatcggtgggttaccacggattacgatgtcgccagagcccgcgacgcgagccttcacggagttgctgacataggcgtcgatgtcgcctgagcctgccaccgacagtttggcggatgtagctaccagctcgctggcatccacgtcgcccgaaccggccatctctgcgtccagcagatccacgcggccaaaggccgtgtgtcccccgaaccctgtacgccaagatcgaggatggtctgttgaagatcgtacagggtcacatcaccactgcctttgatgcggatgctcggcgcttcaggcaatgcgactccgacaatacaacgccctttgaactgcatcgagataccgctctggcgtccaccgacattgatcgttccaccaaaaaaaatgttgccggtaccagatacatgaatattggcaccacctccgctgatggaaacgccttcctgctcgattaccagcttgtcaccctctaaccgggtcttgacgctacgaatgacctcctggttctcccccgccacaaccaggtgtgctgaagggcagcggaagaacacaacatccactgcgcccttgaccacaattttgcgcactaggcggatggggcgctcttccttctcataattggctgcgcgctcccacgcggaatcgcgatgggtggcatcctggagagtcaaagggctggaatgattcatcggtctgtccgtggtgatttagtcagcgtggatctgcgtcatttcgattcatagtcaatcatattgaataataatttgtcgtcaagcgtgttgtcaggttgggctataccctaacctgatgtcaggtggctacatatcaaaccgtcaggttagggttgataatatcatttattgacatatgctaacaacggtcttagatttcaaccttacataaacgggctgattcccgaccaacagaaggttttgacgatgagcagtaaaacgaccgccgcgctgttgagcctcagggcatgtgttgaggatgcgcccgctggaatttacaaggacgccaaggcgtcgggtaagaccattgatgccatccaccctgacttcgaagtctgaggaaaaggccatgtcactcgatcacctgatcactgatgcagttttgagcgcccgtgttgctgctcacaagtgccaattttgcggcagtgatgacgggcactgggaggaagtccatacaggcaacgaagaatcgctagatggttgggaggagtggttttgttgtcacccttgccgcgatgccgataagccttgcgaaacgttcttccctatttcaatcgactcgaagtagtcaggaacagggccactttcggcttttatcatcgagcaggagcaaaccgatgacccaggcaaaccgcatcgacgcctttgtcgcgttttcgtctgtagatcaactccgtgaacttttggcggggattccaggtactgctcaggtcagcatcgacgcactgccagaaggagcaagattcgacacgctggctctgctgactgctctcgacgacggcgacttgtctcccatgcgtgtagcgcgctctgagctacatcgtgttacccgtgtctgcatttgcgaagcaagtggcgtaggccaatagggagtaaaagtgcaatgagtacagacaaggtaaagcaggaactggagcgccttgcaaagcgctattcgctgaatgctgcgggcatgctcaactctggcgctcccgagcatgcccaaacaatagcaattgtcgaattactttcgaatttcgatgacgacgaagctgagagccactgggagacgattatggcgtactcagactttcgcaccagcgatgcgctgttcagcgtcgctgaaacagtcagcgagcaattcgccgtagatcgtcaagtagaagctttgcgtaagcaggttatctcgctcaaatccctgatcgttgacattggtgcggacagtgctgttttaaacctcaacgaccgcctgatcgaacgtatggatgcggcactacttgtaccgcacaactagggaccgtcatgtcgaccttcactgaagatgaaaagcgtaagtgcatcgaactcatgcaccgggaaattgaagacctgcgcacacagaatggctccgtcgcaatccatggtcagcgcatgtatacgacaggcctgctaaccggtttgtcggtagccggagtagtgacgaatggggagtttcgtgaattgtccgaagccatccagttgattggtcgagaagcggcgaacgctaagtccgaccagtaaccctcgactcagcctagggaggcaccttgcagggacaacgtatcggctatgtccgggtcagcagctacgaccagaacccggaacgccagctggaacagaccgtagtgaacaaagtgttcaccgacaaggcctcgggcaaggatacccagcgtccacagctggaggccatgctcggcttcgtccgtgaaggtgacaccgttgtggtgcacagcatggatcgcctggcacgcaacctggatgaccttcggcgcctggtgcaaaagctgaccaagcgaggcgtacgtatcgagctcctgaaggaaggcctggtgttcaccggtgacgactcgcctatggccaacctgatgttgtcggtcatgggggcctttgctgagttcgagcgagcgcttattcgcgagcgacagcgcgagggcattgcgctggccaagcaacgcggtgcttaccgaggccgcaaaaaggccctgtccgacgaacagaccgtcgtcgtccggcaacgagccgctgccggcgaaccgaaagcccagttagcccgtgagttcggtataagtagggaaaccctctaccagtacctacgcacggatgactgatacatgcgccgtcgctcgatactctcggcctctgagcgcgacacgctgcttgcgctgccggacagccaggacgacgtgatccgctattactccttcaacgagtccgacctgtcgctgatccgtcagcgccggggtgacgccaatcgcctcggctttgcggtgcagctctgcctactgcgctatctcggttacgcgctggccagcgacagcgtgctgcccgatccggtcattgagtgggtggcccgacaggttcaggcggcgcccgaaagttgggtcaagtatggcgaacgcgatgtcacccgccgtgaacacgcccaggagctgcgcacctaccttggcttgctgccgttcgggctgtcggactttcgtgccctggtgcgcgagttgaccgacctggcccagcagacagacaaaggcctgttactcgccgggcaggccctggagagtctgcgtcagcaacggcggatcttgcccacgctgacggtcattgatcgggcctgctccgaagccttggcacgagctaaccggagggtctaccgtgccttgatcgagccgctgagccagcagcatcggaacaagctcgacgaactgctgaccctcaaagcaggcagcaacagtacctggttgacctggctgcgacagtcaccgctgaaaccgaactcgcggcacatgatggagcacattgaacggctgaagatcttccagctggcgggcttgcccgaagggctcgaccggcttgtccaccagaaccggctgctgaagctcgcccgcgaaggtgggcagatgacacctcaggatctgggtaagttcgagagcgaacggcgctacgcgaccttagcggccgtggtactggaaagcaccgcgacggtgaccgatgaactagtggatctgcacgaccgtatcctgatcaagctgttcagtagcgccaagaacaagcatcagcagcagttccagaaacagggcaaggcaatcaacgacaaggtgcgcctgtactcgaagataggtcaggctttgctggaggctaaaacctccggtggcgatcccttcgccgccatcgaggcggtcattccttgggacgaattcgccaaaagtgtgaccgatgccgagctgctggcccgccctgaaactttcgaccatttgcacctggccagcgagaacttcaatacgctgcgccgctacaccccggcttttctggaggtgcttcagctacgggccgcaccggcagcgcaacgcgtgctggatgccatccagcagctgcgcgaaatgaacgcaggcaacctgcgcaaggtgccatcggacgcaccgaccgccttcatcaagccgcgctggaagccgctggttatcaccccggaaggtattgaccggcgcttttacgagatctgcgccttgtccgagttgaaaaacgcgctgcgctccggcgacatctgggtcaagggctctcggcagttccgtgactttgaagattacctgctaccacccgcgaagtttgccgcgctcaaacaggaacaggcgctgccattggcgatcaaccccaacagcgaccagtacctggaggaacgtttacatctgctggatgagcaactggcgaccgtcgccaagctggccaaagacaacgagttacccgacgccatcctcaccgagtccggactgaagatcaccccgctggatgcggcggtaccggacaccgctcaggcattgatcgacaagaccagtcagctactgccgcgcatcaagatcaccgagctgctgatggacgtggatgagtggacaggcttcacccgccactttacccatctgaaggatggtgcccaggccaaggatcgaaccctgctgctgtcggcgatcctgggtgacgccatcaacatcggcctgaccaaaatggccgagtcgagtccgggcatgacctacgccaagctgtcttggctgcaagcctggcacatccgcgacgaaacctattcggcagcactggccgaactagtcaacagccagttcaaccacaccttcgcggccaactggggagacggcaccacctcatcttccgatggccagcgcttccgtgcaggcggtcgaggtgagagtaccggccacgtcaacccgaaatacggcaacgaaccgggtcgtctgttctacacccacatctccgaccagtacgcgccgttcaacacccgtgtggtgaatgtcggcgtgcgggattcgacctacgtgctcgatgggctgctgtatcacaagtcagatctgcggatcgaggagcactacaccgacacggcgggcttcactgatcacgtcttcgccctgatgcacctgctgggctttcgttttgcgccgcgcatccgcgacctgggcgaaaccaaactctatgtgccacagagcgtccaggactacccgacacttcgcccaatgatcggcggcacgctgaacatcaagcacgtccgcgctcattgggacgagattctgcgtctggccgcgtcgatcaagcaggcacagtcaccgcctcgttgatgctgcgcaagctgggcagctatccgcgtcagaacggcttggccgtggccctgcgggagctgggccggatcgagcgcacgctgtttatcctgcactggctgcaaagtgtcgagctgcgccgtcgtgtgcatgccggattgaacaagggcgaagctcgcaacgccttgtccagggcggtgtttttcaaccgtctcggtgaaatcagggataggagcttcgaacaacagcgctaccgggccagcggcctcaacctggtgaccgccgccattgtgctgtggaacacggtctacctggaacgggccacccaagggctggctgatgccggaaagccggtgaataccgagctgtatcaatacctgtcgccgttgggctgggagcacgtcaacctgaccggcgattacgtctggcggcagagccgcaagctggaagacgggaaattcaggccgttacgacaggtcggaaaaccttagcgtacgattttttccgaattctgtaggcaccccttcatcatccacatcaggctgtggtcgtgactgcggcaaaggcaatagtcgagcagcgatgtcaatacaccggtaggcgtcagcagtgcgggaagctccgtgtagacacctgtcgcatcggtgtaaacgcgagccttgatggtgacaaacatacgctgtccccagtcgagctgatgggcgagaaaagccaatgcctggcctttgccgaggcacgcctcattggccctccctgagcgtctgagcacgctgccgtggaaaaaagcagaaaggatctggacccctctctcctgcgccggtggcatcaagcctggtggtcggatcggccggcaggtttagaggcaggccctgcgccacgattcatgaggactttagcgaagaagaatcctcctcgttgaacagcgcgcggaaacagtactgatccggcgtggaaacccgccattcaacgtagcgctcgacgcctgcgttgacgacccagtgtagcacccgactcacacgactgctccgctcaggcatggcaggcaactgcgcttgcctcaaacatgctttgcagttggccaataacgcagcgctatcggcttcattgcaacgacgctggagcttacagacacaagttcggccaacagcgactccactgcagcgatggccaatgacgtctgccagcgcagcgtaaatgccgcgtcaacctggagatatgtgaaaaataataggtcaccagcagaaccacgagaaaccatcaggatcactgcacggaaacaaaaaacttcacttatgaagtaccacttttactgaccgagtaacttaggctcaggcaaaaatccatcgagccagacacacagcgcaacgccctgaaaatagcgagcactctgtatggcaccatcacgttaatgatctgtggaaaagcagcccttggattcctggaaaaccgttgtctcgaaaccgctcgtatggcgtagtgggtagcgctgaaaagactccccccgattacctgcaacaaaaaacatcaggcgttggcgaggttttttgatgccgcaaggcgcagtcgatttttctatactttcacgcttgcagtgttatccatctgacagcaaagcggtgcatccttgcgccccgctaaccaaaacaggtacgcatcccttcatcagtcaatggcgtctcgcgtgccgccattggcgcaacgcatccatgcagttatctccgcggttcttgaaatcggccgcgagtgagctgacgagtcgctgccaaacctgcagatgtgtcagtagagaaggatttttttcctgagcaggttcactggctatctggggaaagcgggaaagcactacagagcgagcaatgttattcaacagttcaggatcgtggcgttgaagacagtattccaaatgaacagccagttcttcatctgatataagacgaccggcaacttcaacctcaactacttttgtttggctcatgacgatctccaagaggtgtgcggcctaacgtccgcctagtgataaaagcgtctgaaatgtcgactcgcaaggatatttttttcaaaaatgcagaccagtcgtcatttttttcgaattatttggaactattgtagacggacttactcctcgcgcttgagcgcgaaaaagaggtgcgttatctagtgtggtgtttcgcaagtaccgtagaaaagttggtctaggctctgtagaaaccaactcatcaagagctgtgtatctacatgagccgaccagcgaccgtcattgccctttccgaggccgacaacgcagagcttctacgccgggttaaccagcgcaagggagcccaggatgcttcccttcgtgctgaaatcatactggcatgcgcagatggggaatccggaaactccattgcccagcgccttggtgtcagcaaggacgtggtatcgcgctggcgaattcgtttctctaaatggggattgcctagcctgaacgatgaaccgcgctccggtcgtccacgcaccatcatcgatgaacaagtgcagcaagtggttgatcaggtacttcaaagcaagcccgaagatgcgagccattggagcacccggcgaatgagccgggaaacggggctatctccggctagcgtgatgcgcatctggcatgccttcgggatcaagcctcatctggaaaagacctttaaacgctcaaccgatccgctcttcgttgacaaggtccatgacatcgttggcctgtacctgaatccacccgatagagcattggtgctgtgcgtcgatgaaaaaagccagatccaggcgctgaatcgaacccagccagggctacctctggcaccgggcaatcctgcgtctcgcacgcatgattacaaagggcatgggacaacctcactgttcgctgcactggacgtggctacaggagaagtaattggctggttgaaacgccagcaccgcagtaccgagttcctgtcatttctcaaggagatcgatgcattcgttcctgctgatatgccgattcacctaatcatggacaactatgcaacgcacaagacagaaaaagtcaaagcgtggctggcggcacacccgcgttacagcatctacttcacgccgacatctgcctcatggctgaatctggtcgagcggttcttctcgacgctgagtgagaagtggatcaagcgtcaggcgcatgtcagcgtaaaagacctcgagtcctcgattgagcattatctgaaaacgtacaaccagaacccgaagccgtttcggtggcaccgaaaagcggaggacattcttgcctccgtcgctcgtgcagcacgagcattgggcaaatagatttatgccttatttgtgaaacaccacactcccccccctccccttctaaagctacccgccgctacggcggtttttttggcatcgccaaagcattcagtcatgtattagtcgatctttttttaattttattgatacctcgataaccagtcgataaatagtcgatatttagtctagccagggaatctccgatcaagtccgcagatgtgctgaaatacgcctgactacctgatttgagctgcccatgagccagatgagtttttccgacttcgaatacgctggaaaacgcaagcagacacgccgcgaacgcttcctcgccgaaatggatcaggttgtgccctgggcgggcctgttggggctgatcgagccgttctaccccaaggctggcggtggtcgaaaaccttatccgctggaaaccatgttgcgcatccatctgttgcagaactggttctccctgagcgatccggccatggcagaagcgctctacgaaatcacccccatgcgccagtttgcacgcctgacgctgagcgcaccgatcccggaagacaccacgttcatgaacttccggcacctgctggaaaagcacaactggcgcctgcaatcctcgcggttatcaacggttatttgcaggaaaaaggcctgtcgttgcgtcaaggcaccatcgtagacgccaccattattcatgcccccagttcgaccaagaatgaggaagggaagcgcgatcccgagatgcatcagaccaagaaaggtaacccgtatttcttcgggatgaaggcccatattggcgccgatgtagagtcaggcctggttcaccatgtccatggcaccgccgccaatgtggccgatgtcacacaggtcgccgagctgctgcatggcgaggaaaacgccgtgtatgcagacgccggatacactgaagagcacgaaagtcgtgaggtaatctggcagatcgctgccaggcgcagcacctattccaagctgaataagcgcggcctgatctacaaggccaagcgtaaaatcgagtatctcaaagcccagacgcgggccaaggttgaacattcgttccgggtgatcaagcgccagtttggttatgtgaaagtgcgctttcgtgggctgatgaaaaatacggctcaacagctgatgggcgagttgcgcgcctgacgcggagaacctggcgcaaaggcccgcaatcggctggggaaaatccgcatttacgcaaagagcgatgcacgtaggtgagtttccgccttgccgccgctgcgcggcaagttgatcggagcatcccttgctgtccttaatccccccatgaaaaggggtcatcccacaccctgcgagggctacgctttcgcagggtgtttttatttttggaggccatcgtcatgagcgaattggctgcaccggccccatttcgttgccccgcgagctgactacccgcagggtgcgcctatctacccaatgtaaaaagtgtgcagagaaaaatattgttcccgccaagcgcccacttcgttagacgcctcgagcatggcgtataaaatcgacccgcttgccactcacctatcagcacaatgtcgttgaaaaagctttccactctgccacagagtgtttttagataacggcctgagaagagcgcgtgttcccagcgtgcacctgttcggcggcaggcggcacagcattagacgtttgagggcgctcccacttcatcctatgtgtgcggcctggtgcccgcatagtgataaaagcgtcccaatgccgattcgcaaggtcggtctttcagattgcagaccaatcgtccattttttgattttattggaatcgtcacaatgggctattgttgagaacacgtcatacctgttccacggattgtcaatccgtgctcccgatctattgtggggaggctctattactttggactttctttcagcaccttatctaattgcgtgtcgttgatgctaaacgatgcggtgttgagtcgcgcggtgagataggcttcggcaagttgctcctgacgctgggctcttagcgtccgggtcaagtcaccgcgcaactcctccagagtagccacacgcggtgcttgtacctcaatgagtttgatcacatgaaaaccgcctgtactttgtaccgggtcactcacctcaccctgcttgagtcgggccaccgtcaggcgtaccgccggcaagagctgatccagggggtgcaggccgatctctccggaatttttggcactggtcggctctttggagtactcggccaccagagcggcaaagctgcttggattgtcctgagcctttctgctgatgtcccaggcctgcttgcgtgcggtctccatggcatttttatctggagccgggataaaaatctgggcgatgcgaaattgctcggcggtcaaccaggttgattttccggcgtcgtaagcctgctgcagctcagtctcactggggtaaccgcgcggtacctggctttctgagagcaggaagtcttgataaacaatctgctctttcaacgtctgtattttcttttgaacctcgggtcgctgtgaccagccttgagcgcgggcttgttcaaggacagacttctctgccaggcgtttgcgaatccagccttcgagcagcggacgatcggccgttagctgctttcgataatcgatcggcacgttggtcagcaatgtttttaattcgtcggggtcaacggtcaggtcgcccaatcgcgccacggccacggcgccgggtttacctttgagcagatgggacagaacctcctgaaccttaggatcgtggggcaggcgcacaccgaggctcagcacgatcaccagcagcacgagcgcccccaggctgataacgatgttttttttactcacagctctgtgacctcttctgaacgctgggatgggctgtcaatcttttcggcctcggcctgcaactgcgcgacatgctggctgtactctcgcagataaacgacgagctcttgaatcacccggtcccaaagttcagcgtggctacgcaggtgatcggaactcacgccgcctttgaccatcacgtccatttcaatggacaagaattcgccctgcagggccaggcgtgcaaaacggcgcgacgcattccagaactcaacggtcccacgaggcaattccccctgcacgcgcaggacgcagctaaaggtgaagtccaggtagcccccctcctccagtgctgggctaccgaaacgcaccgaataaccgataccttggctggcactgagcaattgcacaccgccactttcttcggtctgggtgacccgataacccgtgctctgcaacgtttcggtcagcgactgaggggtaacactgtcaatcagttgcacttgagtcatgctcgattctctctcactagacaggtggggtatttccgaacaacttcatcactcaaacagccaaggcattttcaggctgacctttcatatcggaccattcagttcagtgtgttgactggttgtgtgtccgcagtattggcgccggacccgcccatcagatgtaggaaatgctttactctcgcgtaggaaaacccctcactccatgttcttgcgttgagcccgtgcaaccttgggcgcccttgcctgccgagccgcccgggcacgggtggaggtgggttcacccgtccctgcgttttaccaactcaccttgattccgacactgctttgcagcgtcgagccgactttcgcctgtcctgtgccgctgcccaggatgtcgcccacttcagcgtacacactggtgctcttgttcagcgccagggtgaagccggtggacacttcagtagaggtgtagccgatgccgttgtgaatggccgtcgtacctgcggcgggtgttttgaaacgcgtggtatcggttgcgtcaaaaccgtgccacagatccactcgcacatagggttccaggcgtcccaagtcggtgttgaaggcactggtcaaacgcaagccgacgcgcccgaccactgtcgtgttccggctttgcgcgacggttgtgtgaccgctgatcctggtgttacccaggttctgctggttaacgatcaattgcgcctggggctccacggccagatcgccccagcccgtgttcagtgcgaaacgctgccccacttcagccgaggccgtgacactgttgccaacgctgtgatgagtaccgctcccggccttgtcagacatgtcgtgatgaccgtactgcagcacaaagtctccgtactggttcttctggttgacgtaggaggcatagccgcccaggtactcgctgtcagacttcaggctgccggcctgtgcagagccgcccaagccatactgccccttgacgtcagaatcgagacgcaactgcccggcataaagaccggcactccagtcaccgttactccacaagtcgatacccacttgcatgccttgggcgctggtgttgctgtgcggcgacgtggtgcccttttgctcgatgctgctgcggttgttgatggctcgggtccagacccggtttccgctttcagcccccacggtggtgcccgtactctgatctccgacgcgaccgtgcagggtggacagcatcgccagatcactttgccgtatcacccccggtaaggctgcatacacgggcacgtcggcccgatacgtcggcttggacggttggctcgggccggtaccgccatcggttgtggagcgcaaaaaccagtcttcgcccgcccccttggcgtcggccgcatacagacggtattgatacgcaccggcatccacatgaccgtttaccagggtgaacgcgtccttggtggtctgggccgtggtcgtggcaccgttctgggcactgaccacgacaataccgtcgccgcgggtcaaggccccgaggccgcccttgttggtgatgctcagggtggtgtggcccatcgtactggcctgggcgccgttgagcaccagacgatccgtcacgctgccgctatcgcccaacaccgtgctcaactgcacaacaccgtcgcggcccacataagcgccctgaacgatcagggtggtgcccggtgcagcgcctgccagggaaaccgtgccactgttgtccaggctggccagggtttgattgaagccggccgtgtccagcacggccccttgggcgatcgtataatcggaggcgttgctcaaggcgttggtcgcccccgcctgcaggcgtccggccgataccgtcgtcttaccatggtaagtgttcaacccgctcaacaaggtggtcccacttcccatttgctgaacagtgcccgtgccggagatgaccccgccatagctgtaagtgttgctgcggttgaagaccagggtggcgttgttgagcacatcgcccgtgcccagcgagcccgtggtgccaccggcaccgagctgcaggctgccctgagtaatggtggtggtgccgccatagctgttgtccgcggtcagtaccacggtgccgcccaggtctttgttcaaggcaccgctgccggtgagcagaccttgcagggtcagggtatcgcccgcatcagcctcgaacgtaccgcctcccgcgttgagggcgacggtccgggtggtggtgaggctgttggtggcgtgcagcgtaccgccatccaaggacaatccaccggcggcatcgccgaggttgctgtcgctggccacctgcagcacgccgccattgatcgcggtaccgccgctgtaggtgttgaccccattgagcaccagagtgccggcactggtcttgttcagcgcaccgctgccggcgagcacgccgttgaggttcagggtggtggccgccgccacatcaaaggtgccgcctgcgccagtgagggtagtggcctgtggggagaccgccgccaggctaaaggtgctggccgcgccattgagggtgatggcccgcgtggtggagaagctcgcggtggacttcagtgtcccgccactcagagacagtgcgccggcggcatcgccgaggttgctgtcgctggccacctgcagcacaccgccattgatggcggtgccgcctgtgtaggtgttgtccgccgtcaacaccagggtccccgccagggttttgatcagcgagccggtgccggtgatgcccccgcctaaggtcagcgtattgccggcgtcaatgccgacagcgccgccggcattgaggctgacctgacgttgggtggcaaagctgctgctagtctgcagcgtaccgccattgaagaacaatccaccggcggtatcgccgaggttgctgtcgctggccacctgcagcacgccgccattgatcgcggtgccaccggtataggtattggcaccgctcaacaccagggtaccgaggttggttttgcgcagttgcacagcgccctgcaagaccgcgtcaatgctggccgtcactcccggggtgacctggatcgcactggagcctgacccggcaacggtctcgagcagggtgaccgggccgccggtgatgacgtagccatcgctcaggaactgcatccctgtggttcggatttgccccagactattgtcgacggtaaccgtgccagcttgcccctggaagatggcataggtatcggtcacaaaaggtgcgttcacactgccgctggcatcggtccagttttcattattgccggggccgtaattccaagtgccgtcgccgccatcgacggtcgcgttgttccggctactggccagcgaaccgtcccaaaagctcagggtctggccactgctgttgatgaggttgacttcatgagcctgcgacagttgcaggctgagattgctgaggctgaccggcgttgtcgcgatggtcaaaccgttgttgctcagcgtccccccgtagttgaagaggcgataaacccctacgtcgaatgttccgcccgtgggcacggtcacattcaactcgccacccagcgtgagattgcccccgagggtgaccaggtcgttcataggcccgccgaccacattggccgcgcctagctggtaagccaggttcacgccatcgttgatcgtcaggtcgccattgatcgtcagcgtaccgaccgaggccacggcatcccctggcgtcagggtcgcgccactggcgagtaccatgctgccccccagtgtgccgttaccgcccagcgtggcccctgcggccaccgtggtcaggccttgcgccccggcctggttgccattgacgaacagtgagccgcccgtcacggtggtggtgccgctgtaggtgttgctgccgctcaacacggtggtgccgctgcccacttgctgaacagtgcccgtgccggagatgaccccaccatagctgtaggtgttgctgcggttgaaagtcagggtggcgttgtcgagcacatcccccgcgcccagcgagcccgcagtcgtggcatcgcccacctgcagcacgccgccgttgatcgcggtgccacctgtgtaggtgttggcagcgttgagcaccagggtgccggcactggtcttgctcagcgcaccgctgccggcaatcacgccgttgaggttcagggtggtggccgccgctacgtcaaaggtaccgcccgcgccattgagggtggtggcccgggtgctggagaaactggcggtggcgctcagggtcccgccatccaacgacagtgcgccggcggcatcaccgaggttgctgttgctggccacctgcaacaccccgccattgatcgcggtgccaccgctgtaggtgttgctgccgctcaacacggtggttccgctgcccgcttgctgcaccgtgcccgtgccggagatgaccccgccatagttgtaggtattgctgcggttgaaggccagggtggcgttgtcgattacatcgcccgtgcccagcgagcccgtgctgccgccggccccgagctgcaatgtcccctgagcaatcgtggtgatgccgccatagctgttgtccgcggtcaataccagggtgccggcattggtcttgctcagcaagccgctgccggcaagcacgccattcagattgagtgtggtggctgccgccacgtcaaaagtgccgcccgtgccagcgagggtggtggcccgtgtgctggagaaactgccagtggtgctcagcgtcccgccatccaacgagagtgttcccactgcagcgccgaggttgccatcgctggccacctgcaacaccccgccattgatcgcggtaccgccgctgtaggtgttgctgccactcaacacggtggtcccgctgcccacttgctgcaccgtgcccgtgcccgagataaccccgccatagctgtaagtgttgctgcggttgaagaccagggtggcgttgtcgattacatcacccgtgcccagcgagcccgtggtgccgccggtacccagctgcaggatcccctgagcaatggtggtggtgccgccatagctgttgtccgcggtcagtactagggtgccggcactgatcttgctcagcgcaccgctgccggcaagcacgccgttctggttcaatgtggtggctgctgccacgtcaaaggtgccgcccgcgctgttgagggtggtggcccgtgtgctggagaaactgccagtggtgctcagcgtcccgccatccaacgacagtgttcccacagcagcgccgaggttgccatcgctggccacctgcagcacgccgccattgatcacggtgccgccggcgtaggtgttggccccattgagcaccagagtgccggcactggtcttgttcagcgcaccgctgccggcaatcacgccgttgaggttcagggtggtggccgccgctacgtcaaaggtaccgcccgcgctgttgagcgtggtggcgcgggtgctggagaaactgccagtggtgctcagggtcccgccatccagcgacagtgcgcccgcggcagcgccgaggttgctgtcgctggccacctgcagcacaccgccattgatggtggtgccgcctgtgtaggtgttggcagcgttgagcaccagggtgccagcactggtcttgctcagcgcaccgctgccggcgagcacgccgttgaggttcagggtgctggctgccgccacgtcaaaggtgccgcctgcgctgttgagcgtggtggcgcgggtgctggagaaactgccagtggtgctcagtgtcccgttgtccagcaacagcgcgccggcggtatcgccgaggttgctgtcgctcgccacctgcagcacgccgccattgatcgcggtgccaccgctgtagctgttggtcccgttgagcaccagtgtaccggcgctggtcttgctcagtgaaccgctgccggcaagcacgccgttcaggttcagggtggtggcggccgccacgtcaaaggtgccgcccgcactgttgagcgtggtggtccgcgtgctggagaaactgccagtggtgctcagggtggcgccattcaacgacagcccacccgcggcagcaccgaggttgctgtcgctggccacctgcagcacgccgccattgatcgcggtaccgccgctgtaagtgttgctgccactcaacacggtggtcccgctgcccacttgctggactgtgcccgtgccggagatgaccccgccatagctgtaggtattgctgcggttgaaagccagggtggcgttgtcgagcacatcgcccgtgcccagcgagcccgtggtgccaccggcaccgagctgcaggctgccctgagtaatggtggtggtgccgccatagctgttgtccgcggtcagtaccagggtgccggcactggtcttgctcagcgtaccgctgccggcaagcacgccgttcaggctcagggtggtggcggccgccacgtcaaaggtgccgcccgtgccagtgagggtggtggcccgtgtgctggagaaactggcagtggtgctcagggtcccgccatccaacgacagtgcgccggcggcatcaccgaggttgctgtcgctcgccacctgcagcaccccgccgttgatcgcggtgccgcctgtgtaggtgttggtgccgttgagtaccaaggtaccggcactggtcttgctcagcgaaccggcaccggcgagcacgccgtttaggttcagcgtggtggacgccgccacgtcaaaggtaccgcccgcgctgttgagcgtggtggcgcgtgtggtggagaagctggcggtcgtcctcagtgtcccgttgtccagcaacagcgcgccggcggtatcgccgaggttgctgtcgctcgccacctgcagcacgccgccattgatcgcggtgccaccgctgtagctgttggtcccgttgagcaccagtgtaccggcgctggtcttgctcagtgaaccgctgccggcaagcacgccgttcaggttcagggtggtggcggccgccacgtcaaaggtgccgcccgcactgttgagcgtggtggtccgcgtgctggagaaactgccagtggtgctcagggtggcgccattcaacgacagcccacccgcggcagcaccgaggttgctgtcgctggccacctgcagcacgccgccattgatcgcggtaccgccgctgtaagtgttgctgccactcaacacggtggtcccgctgcccacttgctggactgtgcccgtgccggagatgaccccgccatagctgtaggtattgctgcggttgaaagccagggtggcgttgttgagcacatcgcccgtgcccagcgagcccgtggtgccaccggcaccgagctgcaggctgccctgagtaatggtggtggtgccgccatagctgttgtccgcggtcagtaccagggtgccggcactggtcttgctcagcgtaccgctgccggcaagcacgccgttcaggctcagggtggtggcggccgccacgtcaaaggtgccgcccgtgccagtgagggtggtggcccgtgtgctggagaaactggcagtggtgctcagggtcccgccatccaacgacagtgcgccggcggcatcaccgaggttgctgtcgctcgccacctgcagcaccccgccgttgatcgcggtgccgcctgtgtaggtgttggtgccgttgagtaccaaggtaccggcactggtcttgctcagcgaaccggcaccggcgagcacgccgtttaggttcagcgtggtggacgccgccacgtcaaaggtaccgcccgcgctgttgagcgtggtggcgcgtgtggtggagaagctggcggtcgtcctcagtgtcccgttgtccagcaacagcgcgccggcggtatcgccgaggttgctgtcgctggccacctgcagcacgccgccattgatcgcggtgccaccggtataggtattggcaccgctcaacaccagggtaccgaggttggttttgcgcagttgcacagcgccctgcaagaccgcgtcaatgctggccgtcactcccggggtgacctggatcgcactggagcctgacccggcaacggtctcgagcagggtgaccgggccgccggtgatgacgtagccatcgctcaggaactgcatccctgtggttcggatttgccccagactattgtcgacggtaaccgtgccagcttgcccctggaagatggcataggtatcggtcacaaaaggtgcgttcacactgccgctggcatcggtccagttttcattgttgccggggccgtaattccaggtgccatcgccaccgtcgacggtcgcgttgttcctgttcactgccagtgcaccgtcccaaaagctcaggctctggccactgctgttgatgaggttgacctcatgagcctgcgacagctgcaggctgaggttgctgaggctgaccggcgccgtggcgatggtcaatccgttattgctcagcgtcccgccgtagttgaagaggcgataaacccccacatcgaatgcaccgcccgtgggcacggtcacattcaactggccgtccagcgtgagattgcccgcgaggatgatcaggtcgttcataggtccgccgaccacattggccgcgcctagctggtaagccaggttcacgccatcgttgatcgtcaggtcgccattgatcgtcagcgtaccgaccgaagaaagggcatcacctggcgtcagggtcgcgccactggcgagcaccaggttgccccccaaggtgccgttaccgcccagcgtggcccccgcagccaccgctgtcaggccttgggccccggcctggttaccattgaccaacaatgcgccgcccgtcacggtggtggtgccgctgtaggtgttgctgccactcaacacggtggtcccgctgcccacttgctgaacagtgcccgtgccggagatgaccccgccataactgtaggtattgctgcggttgacggtcagggtagcgttgttgagcacatcgcccgtgcccagcgaacccgtcgttgtggcatcacccacctgtagcaccccgccattgatcacggtgccaccgctgtaggtgttggtcccgttgagcaccagggtgccggcactggtcttgctcagcgcaccggttcccgagagcacgccattgaggttcagggtggtggccgttgccacgtcaacggtgccacccgcgccagtgagggtggtggcccgcgtgctggagaaactggcagtggtgctcagggtcccgccatccaacgacagtgcgccggcggcagcaccgagattgctgtcgctggccacctgcaacaccccgccattgatcgcggtgccgccgctgtagctgttggtcccgttgagcaccagggtgccggcactggtcttgctcagcgcaccggttcccgaaagcacgccattgaagttcagcgtggtggccgccgccacgtcaaaggtgccgcccgcgccagtgagggtggtggcccgcatgctggagaaactgccggtggtactcagggtgccgccattcaaggacagcgcaccggcggcatcacccaggttgctgtcgctggccacctgcagcacgccgccattgatcgcggtgccaccggcgtaggtgttggccccgttgagcaccagggtgccggcactggtcttgttcagcgcaccgctgccggcgagcacgccattgaggttcagggtgctggctgctgccacgtcaaaggtgccgcccgcgccagtgagggtggtggcccgcgtgctggagaaactgccggtggtactcagggtgccgccattcaaggacaacgcacccgcggcatcaccgaggttgctgtcgctggccacctgcagcacaccgccattgatcgcggtgccaccggtgtaggtgttgctgccactcaacacggtggtcccgctacccacttgctgaacagtgcccgtgccggagatgaccccgccataactgtaggtattgctgcggttgacggtcagggtggcgttgttgagcacatcgcccgtgcccagcgagcccgtggtgccaccggcaccgagctgcaggctgccctgagtaatggtggtggtgccgccatagctgttgtccgcggtcagtaccacggtgccgcccaggtctttgctcaatccaccgctgccggtgagcagaccttgcagggtcagggtatcgcccgcatcggcctcgaacgtaccgccgcccgtgttgagggcaacggcccggctggtggtgaggctgctggtggcgtgcagcgtaccgccatccaacgacagcgcgcccgtggcagcaccgaggttgccatcgctggccacctgcagcacgccgccattgatcgcggtgccaccggcgtaggtgttgaccccattgagcaccagggtgccggcactggtcttgttcagcgcaccgctgccggcgagcacgccattgaggttcagggtggtggccgctgccacgtcaaaggtgccgcccgcgctgttgagggtggtggcccgtgtactggagaaactggcggtggtgctcagggtgccgccattcaaggacagtgcgccggcggcagcaccgaggttgccatcgttggccacctgcagcacgccgccattgatcgcggtgccaccggtgtaggtgttggtacctgtgagtaccgtcgtcccgctgcccacctgctggacagtgcccgtgccggagatgaccccgtcatagctgtaggtgttgctgcggttgaaggtcagggtggcgttatcgaccacatcgcctgtgcccagcgagccggtggtgccgccggcacccagctgcagggtcccctgagcaatcgtggtggtgccgccatagctgttgtccgccgtcagcaccagggtaccggcactggtcttgctcagcgcaccactgccggcgagcacgccattgaggttcagggtggtggccgctgccacgtcaaaggtgccgcccgcgctgttgagggtggtggcccgggtgctggagaaactggcggtggtgctcagggtgccgccactcaacgacagtgcgccggcggcagcaccgaggttgccatcgctggccacctgcagcacgccgccattgatcacggtgccaccggcgtaggtgttgaccccattgagcaccagggtaccggcactggtcttgctcagcgcaccgctgccggcaagcacgccattgaggttcagggtggtggccgctgccacgtcaaaggtgccgcccgcgctgttgagggtggtggcccgggtgctggagaaactggcggtggtgctcagggtgccgccactcaacgacagtgcgccggcggcagcaccgaggttgccatcgctggccacctgcagcacgccgccattgatcacggtgccaccggcgtaggtgttgaccccattgagcaccagggtaccggcactggtcttgctcagcgcaccgctgccggcaagcacgccattgaggttcagggtggtggccgctgccacgtcaaaggtgccgcccgcgctgttgagggtggtggcccgggtgctggagaaactggcggtggtgctcagggtgccgccactcaacgacagtgcgccggcggcagcaccgaggttgccatcgctggccacctgcagcacgccgccattgatcacggtgccaccggcgtaggtgttgaccccattgagcaccagggtaccggcactggtcttgctcagcgcaccgctgccggcaagcacgccattgaggttcagggtggtggccgctgccacgtcaaaggtgccgcccgcgctgttgagggtggtggcccgggtgctggagaaactggcggtggtgctcagggtgccgccactcaacgacagtgcgccggcggcagcaccgaggttgccatcgctggccacctgcagcacgccgccattgatcacggtgccaccggcgtaggtgttgaccccattgagcaccagggtaccggcactggtcttgctcagcgcaccgctgccggcaagcacgccattgaggttcagggtggtggccgctgccacgtcaaaggtgccgcccgcgctgttgagggtggtggcccgggtgctggagaaactggcggtggtgctcagggtgccgccactcaacgacagtgcgccggcggcagcaccgaggttgccatcgctggccacctgcagcacgccgccattgatcacggtgccaccggcgtaggtgttgaccccattgagcaccagggtaccggcactggtcttgctcagcgcaccgctgccggcaagcacgccattgaggttcagggtggtggccgctgccacgtcaaaggtgccgcccgcgctgttgagggtggtggcccgtgtactggagaaactggcggtggtgctcagggtgccgccattcaaggacagcgcgccggcggcagcaccgaggttgccatcgttggccacctgcagcacgccgccattgatcgcggtgccaccggtgtaggtgttggtacctgtgagtaccgtcgtcccggtgcccacctgctggacagtgcccgtgccggagatgaccccgtcatagctgtaggtgttgctgcggttgaaggtcagggtggcgttatcgaccacatcgcctgtgcccagcgagccggtggtgccgccggcacccagctgcagggtcccctgagcaatcgtggtggtgccgccatagctgttgtccgccgtcagcaccagggtaccggcactggtcttgctcagcgcaccgctgccggcaagcacgccattgaggttcagggtgctggctgctgccacgtcaaaggtgccgcccgcgctgttgagggtggtggcccgggtgctggaaaaactggcggtggtgctcagggtgccgccactcaacgacagtgcgccggcggcagcaccgaggttgccatcgctggccacctgcagcacgccgccattgatcacggtgccaccggcgtaggtgttgaccccattgagcaccagagtgccggcactggtcttgctcagcgcaccgctgccggcaagcacgccattgaggttcagggtggtggccgctgccacgtcaaaggtgccgcccgcgctgttgagggtggtggcccgtgtactggagaaactggcggtggtgctcagggtgccgccattcaaggacagcgcgccggcggcagcaccgaggttgccatcgttggccacctgcagcacgccgccattgatggtggtaccgccggtataggtattggcgccactcagtaccaaggtgcccagatcggtcttgcgtaactgcaccgcgccctgcaggaccgagccaatggtggccttagctccctgagaaacctgtattgccgtagagccagaaccattggccgtttcgaccaaggtaagaggatcaccgctgatcacatacccgttgcttaggaactgcaggcctgaggtttgcacctgccccaggctgttatcaacggtcaccgtgccggccagtccctgaaaaaccacaaaagaatcggtggtgtaggttgagttcaccgctccgttggggtccgtccagtggtcattggcgcccaccccacctaccgcgtaattccaaataccattacccccgtcaaccgagccattgtttttctgagtgaccacggagccatcccaaaacccaagccgttgaccggtagtgttgacgaggttgatttgccctaggatcgttttttgtagcgtgagtgtggtcgcggtgggcacgctcccgatcgccagattgttgtcggtgaaactgcccgagtagttgaacacccgataaatccctggatcgagtgtgccaccgggtgcaacgctcacattcagcagacctcccaacgtcaggttgcctcccacattgacgaggtcatcctgcgcttggcctgccacgatgccgaaggtgtagttgaggttggcgccactgttgacggtgacgttgccattgatggtcagcgtacccccccccccgccactttggcgaggtgccagggtagcaccattggcgaacaccacatcgcccccgacagtaccgatgccgcctaaggtgccgcctgcggcaacagtggttaaaccggtggacgccgactgattaccattgacgaacaacgttccggccgtaacggtcgtggaaccgctgtaatggttatcaccgctcagtacaagtgtgcccaggtcggacttgatcagaccaccggtgccggtaatcaccccgttattcgtaaacgtgtggcctggcgacacacggaacgtgccgccccctgcattgagggtcacggcgcgagcggtggcaaaactattgctcactgccagcgtggcattgttcaaactcagggcactcagaacgttgcccagattattgtcggcagaaacctgtacctcaccaccattaatcgtcgtgccgccactgtaggtgttggcagcattgagtaccaaggtaccggtgtcggttttcgtcagggcgccagcgccatcaccgtcggcaatcacgccatcggctgtgagggtcgtaccattggccacctcgagcgtggcgcctgcggtattgatcgccagcctgtgcgtcagggcgaagctggcagtagtgcccagtgtgccgttgccgatggtcagggcgctggaggttgcgccaatatttgtatcgccggagatattaatctggccagcggaaatcaaagtgccgcctgtatagctgctgtttcctgtcagcgtcgtggcaccagtaccaatttgctgtacttgtcccgccccgacgatggatgaactaaacgtcaaagcattgttgcgattaaatactagagtagtgccgccgcttgtctgtattccgggatccacgctccccaaagttcctgtgctgcctccattgccgatttgcagagtgcccgcattcagggcgacgtttcgtgtatagccgtatccgaacgtattgttggcggtcaggatcaaggagccgttaccactcttgctcaaggaaccgtttacaagctgatcttcaacactatacgtgccatcaatcacacccgcaattgtcagcgttgtattggtatcgacatcaaaaatcgcagctacacccggcgcaatagtgactctacgccctatggtcatatcagccgtggtgttgagcgtccccccgcccatgtagagagcccctgacccagcaccaagactgctgtcgctcgatgtacgcagtgtcccgccgttcacctttgtgccaccgctataggtgttggccattccactcaggtcgagcaagcccccgccggttttgacgagagaaccggacccttggatcggcgtaaccagggtcagtgtggtaccgccgtccacattgaagatccccacgccgttgagaagcaccgcgcgggataacgtcaatgaactaccggtattgagcgctccgccattgaagacaaggttgcccgacgccgccccgaggttgttgtcattggtgacccgcagtgtgccgccattgaaaaacgtgccgccggtataggtgttatcagcggtgagagtggccgtgctgccaccgaccatatggaccgaaccgctgcccgaaatgaaaccgttgagggtcagggcggagccaggatccaggctcaatgatccgttattgaccacattgcccacgactgagccggttgttgtgccatcccccaattgcagggtcccggaggaaatgagggtgccgccagtgtaggtactggcgccagtcagcacggtggttcccagccccacctgctgcacttggcccgagcctgaaatcgcgctcgcgacggcactactggtaccgctggccggattgaagaccagcttcccattgtcaatgataggaccgacgagagatccactggtcgtcccgtcccccacctgcaacgtacccgccgagatcgtcgtaccaccggtataggtattgtgccccgtcagcaccgtggtaccgttaccaatctggctcacgctccccaggccggagatcacgcctgcgtagctcaaggtcgtcgaagcggtcggattgaaggccagtgttcccgtagttgtaccggctgcaccggtgctcacatcccccacaatcgaaccagcggtaacgccgtcacccaattgcaacgttcccgccagaaccagggtgccaccggtataagtattggctcccgtcagcaccaagatgcccaggtcggtttttctcagcagtacactgccttgcagcaccgaaccgatcgtcgccgtataacctgccccggcggcggtgccgtcaccgacccgaaccgtcgtcgtcgcggttcccggtgtggtctccaccagggtgagggggtcgccctcgatatggtaaccatccacggcgaattgcatgccggtgctgctcacgctacctgctgtagcgttatccacggtgacggtacccggcgtcgcctcgaaaatggcgtaggcattgctcgtccaagggccattcgccgtgccattggcatcggtccaatgactgttgccactgctcccttgccacaggccgctcccgccgtcgaccacatggttgttctgggtcggcgcaccgaggccgccatcccagaagagcatcgacgtcgtcgatgcagcaatgaggttgacctgattggcgacggaggtctgtatggttcccgtaaaacctgccggcaagctgcctatattaagggtgttattggtcagtagacccgcgtaattgaagacccggtagaccccgatttcaaataaaccgctcggtgtctgggtgacgttaagcgtaccgcccagggtcagattgccattgacgctgaccaggtcattgaaaaggccaccggatacaccggcctgaccgaagctgtagttaagaatcgacccattgcccagcaccaggttgccgttaaggctcaaggtgccgatagcattgcccacgtctcccggtgccaaggtggcgccatcggccaaaatgacgttgccgccaatcgtgccgttgccgcccagcgtggcaccattggccacgctgaccaggccggttgccgcgttctgggcgccattaatgtaaagcgcccccgcggacacgtccgttgcccccgtataggtattgttgccactgaacaccgtggtgccagaccccagcagagaaatcgtgcccgagccggaaatcgaaggggacacggtcaacacaccgctgcggttaaagaccaaggccccattgttggtgatgctggcactgcccagcgtgccggtggcgccaccattgcccacctgcagggtgccgctgttgatgatggtctggccgctgtaagtgttgtccgcggccagcacgagggtgccattacctatcttggtaaacccgccaccggtgctacccaccacaccattgaggacaaacagggtgccggcgtcgacatcaaaagctccgccccccgtggataacgtgacttggcggttagtcgtgatgttcgtggttgtgtgcagcatgcccccaaagaagttaatcccgccgacggctgcccccaggtttgcatcactgtcgatctgcagagtgcccgcgtacaaactggtgccgccggtgtaagtgttgtttcccgtaagcaggagcgtgccggctccggtggcgtgcaagttgcctgagccagaaatttgactggtcacggtgagcgttgtgcccgcgttggcggagagcccgccgacgccagtgatcgccacattgcgattggtcgccaggttggctgtcgtctgcagcgtgccattttgcaacaccagtgcgccggcggaggcgccaagggcggtatcgttcgcaatcgacagtgttcctgcgctgacgagcgttcccccggagtagctgttgaggttattggcaaggaccagggtaccggccccgttcatgaccaactggcccgccccgctgatcagcccgttcaggatcaatgtccccgtggtcggggtgaaggcgccttgcccgctattaagcaagacattgcggttgctggaaaaaccggcactggtcaccagcgttccgttgttgaagaccaggttgccggatacatcgccaagatcggcgttggaggcaacttgcactatgccgccgttgatcgtcgtatcaccgacgtagttattgccggtgctggataacaccagcgtaccgctaccggttttggtcagcggaccaccggagacctgcccgcccaaggtcagtgtccccgccgcggtgctgatcacaccgctattgagcgtcaccgaacgcgccgaagtgaaagtagccgtggagaccaacgacccaccgttgagaacgagcgcgcctgaggcggcgcccagattattgtcggcggaaacctgcagcttgccggcattgatcgtggtgttacctatgtagctgttggcgccggacaggacggtggtacccgtgccgttttgggtcaaaccaccgctgccggagatcaggcctgcatacgtgtatgccgtgctgagattgaaagtcagcgtgccgttgttaacgacattgccggcgcctaactggcctgtggcgccaccgttgcccacttgcagcacgccagcgatcgaggtggagccggtgtaggtgttggctgcggtgagcaccagcgtgccagtgttggcctgcgtcaggttgccgatgcctgaaatcaccccgctcaaggtgagaatttgccctgaggccacatcgatactgccgtcgttgatgcccagtatggtgttgcgggcgctcgtgaaggatccggcgctggccagcgtgccaccgttgagtgtgagcacgccgttggcggcgccaagattgttatcgacaaagacctggatcgtaccgccgttcaccgtcgtgtcgccggtataggtattgaccccgctcaacgtcagggtccctgccccggccttgatcagcgtaccgttgccggagatgctggacacaatcgacgcggttcccgtcgtcaccgtcatcaacgaggaggccgtggcaaaattcagggcggcgccctgcaagagatagccatccgtcaaaaacgtaagattctgaatggtcatcggttcgctcaacacgaccgtgcccgacggaccgccaaaggtcgcactgtccccagccaggttgctccacggccgggtgaccgtgccgtcgaaccactgcccggttgtcgtgtcccagatgccgctgccttgaggcccactgggaacccaggtgagatcttcagccttggcaggttgggccagcatcagcatcaacattgacattgacattgacagggacgtcagatgggggcccatcaatgccctgctcgcaagcataaagatcccaggcgaggtttttttcttgatgtcggttaatgaagtaacggaattggaggcgcaaggcgattttcctcgacccttggccagttcggatgccacgacccaacagccgagggaggcattccatacaactcgataaaccgcattcattaacaacccccctatgcagtgcaaacaataaaaattgatgacgctaaggttgctaaaacggcgaccgccttgttacaggcgtaacttgtccccactcattcgttgtttttgagttccacaggggcgataagggtgcgcgcgccaagacggatatcttctcttgagcaggcgacgcttgctcgacaccgaatcggtgccaggtagagaaacgatctgccaaaggcacagggggttgatccgtttcagcaagtcaatccaaaaaaccccgtgctgacccgtcttgacgaaggaggggttatggcgagtttgtttacgctggccggcgtattcaaagttgaaataactgatctggctcataagtggctcgaggcaagctatgaaaggggacgaggtctatcaatacgtcctcattagagaagagtgccttgaggcgaatcgaattacctgaagttgacaatgagcgcagctgaaagacgtctcttcgtacacctatcaaaggttagaaagcatcacttcttccaatcaataaccatcattttttatcaacaatatttttatgacattgcattcggctgggtatgggcatcgaacaacatcgggtgaccttggctgggataagcaaccgaccagaaagcacgactggcgcacagcgtcatatggcagacctgggatacgtcgagacagctcctcgaccagcataccttcctcgctccagtcaaattgaaaagcctccccgagagcaaaagtccgtggtacaaaagcgcgtaaagacttgccttgctcgcctcgccaaaagggtacaaacgccatgagcgggctgtagccgccgtcgtaagcttcggttttgatcagctagaaaagcgctttggcgcttccgcggttgtgctttgcccaaaacgaatcgaccttgagcgcctgctctaacatgtcgtggaatggactgaggttattgaaggtggcgcaccgttggtacgccggctaagtggcttcgggcgctctgactcattttaggagggtgtttctcgtcggcgcggtacgcttggctatctgatgcagtgagcgcttatcgcgaagtacatccgccagatttttcccaacatttccatgaaaaaataaaagcttttctcgagtggattgactctttgcccgccgcgatcaaggtaaagtttacgctgatatgttttatcaacaccacgacgagggtgtccaggtggacttgcccctatcaaactggacaccggcaccccgttaagttgatgcctcagccagacgcctgaactcccgaggtgagcggcagttcagcgcgctgtgcggatgttcctcgttgtaatgctcgaaggcgatggccaggttacgtagggccgtcgctcgatcgggcttgggcatgtgacggatgtagtcacgcttcatagtcctcacgaagctctccgccatgccgttgctctgcgggctgcacacaggagttgtcaggggcagcaggccgatctgccgggcaaagccccgggtctgttcagcggtataggccgagccgatatcgctcagccattgcaccggcgatgtcggtagctggttaccaaagcgttgctcgatagcttccagcatcacgtctcgaacatcgtcgccactgtagctatttgggctggccacccaactgatggcctcgcggtcgcagcaatccaaggcgaaggttacacgcagtttctcaccgtcctcgcagcgaaactcgaagccatccgaacaccagcgggtgttgctcgtgtccacagcgacgcgaccttcatgacgccgcgccatccccggctgcttgcgccggtgctccagcaacaggtcgtggtctcgcatgacgcggtacacccgcttcacgttgaccggtggctgggcctgctgctcatgctgtcgacgcaaaaggccccagacccggcgatagccatagctgggcaatgcgccgacggcctgcttgatccgctcgaccagggccgcatcgttgagcgtccggcgacgacgcggctgcacccccggagtgggctgtttgagcccagccgtcaattgcgagcgcgccacaccgagactctcactgaccgctttcactggtcgtcccccggcaacaagggtgagcgcgcaatccatttcgcgagcgggcgatctccaccgcttcattgaggatttcagcctccatggtcttcttgcccagcatccgttgcagttcgcggatctgcttgagggcatcggccagctcggaagcaggcaccaccgcttcaccggcactgactgccgaaaggctgccgtcctggtagagcttgcgccagtggaacagttggttgggattgatgccattgcgctgggccaccaccgagacgctttgcccaggccccaggctctcgcgcaccatggttagtttctcctcgacgctccaacggcgacgccgctcctggccgagcacttcgatgcttttgtctttgctggtagtcataaacacagtcgtttgcctatcccttatcgtaaggggaaaacggtgtcctgtgtttcaaggggcttgttcacccaggtaaatcattgcctgcgtgtcggccaacggcatcaacgtcaacctgctgcgggtggcaattatctcagggtggcggcccgcgtaggattggccagtacaaaaccactcaatacatggctgaaggcagaagaggcattgcacctcttctgctcattttccgcgattattatcgtctcctctcgagacatcagaaagggtcagcgctggctcgcttcgtcacactcatagcctaggccttgacgctttcaagcagccggggcaatcattttgatgatcccagaaagcgtgaaaagcatacatttatgtgcgtcctcagcaaggatggctttgaccagttgctcaatgctgatgacgactgacgaattcacctcgatttgcagatgttgatgcactgtacgcgactcatcgaacacccggcgtacgatcaagacggttgcccgttcggaatcagtcagccaaaggtcgttctcgtatcgacgcacgagaatccgatccggattttcctgtgccaggatcagccgatccagggcttgctcggggtcttcattgtcaatgacaaccgttgggtaatgccgcgccatggcctggctgaggcgatagcaatcctctgcgccgcccccctgcagtatcacgttgtcgacaccggcaatgatcggtgccgtcagatcgccctgacggctttccccgccttgcagtacaagagacgtcccgaaacgttcggcattggcgaaacggctcagtatctggctgccacggctatgggtttgatacagcgtatgatccgctgggttatacacataagccgccttttcttgcgggacgacacccagaaaacgcagattgtccacggcaggaatgtcgtgagaccagaacacctggccactggcgacatcgaaccaaccttgcgtgagcgaagggcgtgcatgcgagccgtacaagatcagtacgcctttgacctgccactgagcggcggtttgagcaagagcctgagccagcgtgtcgaggtgatctttctgccaacctttgtcgaccgcaatcagctgaagctcgccgctatgggctcgcatcaggacttcgcccttgacggtggtcaagcgtagaccggcctcggtttgttcggcggcccgcagatgcagtgcgggcatcaactcacgtgccgctgggcactgcgccgatggtttaagcacataatcggcatcaaatgcagctgccagcgcttgcggcgtcatggctggctggccatacagcttaccgctctcgggggcgaacagtcgtgcggtggatccatccgcttcgaatcccagaaattgcagcgtcttgtcctgcagcgcctgcgaagccactacaacttgcccgttgtgataccacacgggcagtacatgcttgcccccggtgtccttcatcccaaagacggccaaggtggcttccttgccacttaccgtttcaaggttgtcccaccaggtagttcgtcccttgagccagtgctcattgacggcctgataattcattcgtccctgatcatccagttgcgccacgcgtccatcttcggtaatggcaatcgcggtgccgttcacatccaccacactggccagatctggggcttctacccgcaatgcagtaggctgattggcatcgagaatggcttggcccgccccctcctggcgaaacagcacgttttgctctttgctgtaaaagaagaacacttcctcgccatgaggacgtggcaggctccctgccaatatcaggtcggcgggaatcggccaggcgctatggatttgcggtgctgcaaagtgctgtgcctgatccgctggaggtgccaggttcggtttgatcaccagacaatcgcgggaacgaatccagtaacggtgtgcaataccgtctgcatcggtgccgaataccattaccaagggcgcatgggccgggttaaccgtaggggccgacaacagaaagatgggcgccgtacgcaactggcaattgttctcataaccatggagcaattccttgatcgtatcgatgtgctggtcggtacgtgccgagatccacaacagggcatcatcaccttcggcgctgaccagttcgagttgatcgccccagatccggtaccccagccgagcctcacagccatcctcgagcagataagtgcgtatcaggtgaacagcatcgccttcctgccatagctggctgatcttgcccgcactttggctgaaccaaagttcgaactgcatatcaacctgaccggtggcgatcgtgacccgccacaccgtggcgctctcggtgtcatagaaataagcatgatcgccaatcacagcgcccagattcgcgtgctgggcctgttccagagaggtatcggtaaacagcatccgatccttggccacgtcgtaaaaagctcggccaacatgacgggagtcatgctggtagttctccaccaccacatattgcccattcaattgatgcttttgggcaagttcatgcagatattgctcaatggattgatccgcagtccgccacttgctggcatcttcgctcacgatacgagcagtcagcgcggcgaaatcgacatcgcggacttcaccgttatgaccgatcaccagcacgcgagcgttctcaggcaaatcgaggtcaacggcgaagccgccgatcatcaggcgatttttcgagacagtgatggtgtcattagcgagctgcttgctgtcgatgatccagcgtgacggcgcactggcggtaacatctgacagcttgattgtggctccatggttgagcgcaacaagatactcacctcctcctcctttgacctcgtagtgcagatagccatgcagctctttgggcaactcgggcatcaacagatggcgattatgctgatcgagcagcaactggaccgtcgtcgccacgtattcgtgatgaatcttgctgacggtatattcagatggaaaaatgtagaagtcgtaatcgaagcggtaatccttttccagcttgcggatgacatcgaaacccgaatcgtggcgagtcgtggcacccgggaaatggatgtagccatagctgatgtaggatttaaccgtgccgggtaggatgatcgccttgctgtcgccatgagcgagcgcctgctggctggaataaccgatgccactgcgcacctcaatggcctggctgcggtcgtgaaccatggtggggaagtcgccaccccagaagaaatagttgattttccccgagcccgttttgccgtggtgcgtgcgatagaggtactggctatcgaactcgatctggttctggtacagatccagggtcttgatgacggcgccgggaagaggtaccagcacctgttgctgttcgtcgtagcggtagccattgcctttgtaggcggcgtcaacggcggcaaaatagcggccgacggccttgatatcttccgccaccggcgcaaatgcctgtgccagtcccgtgaagcccaccgcgagccctcccagaatgacacctgcgccccccagtacggcgccggtcgtcgaagcccccaacatcccagcaccaattcctcccgcactcgagacgaaactggccgcatcaaacgccaactgtgtgccgtagacagccttctgtccttcactttcggcatgtgccagttcgtaggcatccagccccacaaaagcgccaccaaacagcaccccagcaccttcgctcacagtgtggcccagcgaggaggcaaaatccttgagagaggtttgtgcggcaatcgcctcgccgcgcaaggcggtacgcaccagagcaatgaccttgaccacgtcctgaataccgccatgaatcatctgggagatattgaggtagctgtgcactttcaaggcgagcgccagctcaggtgtttcagtgccgttggaggcatcctggcggcctttatcggtaaaccaacgaatcagtgcctgtaccgcaaaacctgcgttcaggccgtcaaccggcgaggcttctgcggttcccgtccgaggccgcagttgaccatgctcaagggtaaagtgctcgcccagggtcgacgcgtgttcatcgacaaagtcgcgaaactggacaaaggtggcgtcgtcggtgttcagccagcgtgtttcctcaggttgctcacagttgatgaactggagctcgtagtgcccatcagcctgcgtccgagtgttggcaatcaccggcatccagcgatgatccaggcctgcttgcagagccagtcgtgaagtggcttcatgatatttagctccccactgttcggcatcgaagctcaccaacgaactacgtagcaatgcgtcctgggcagcgcgctcctgtgcattaactgtctgctgcacttgatgtcgagcttccagcacattggccaactcacccggttggctcagatcagccacgttcaagtgacgccccagaggcactacagccatctgggctgcatcgatttgcaccagatcaaaaatgggcgctgtggcactgcctaatgcaccgtaaaaaacaccgagtgaacgtttgaccagatgctgcatcatcgcgtcggagagattatccagactgtcgaatgcgaaaacccccacattcggatcatagaagtaataacgacgtccttctgtgccaatgaggcttgccaccatcatcgaatggcgttgggtattgagtgcaaaaatggtcgtttgagtcgtcttggccaaccgagataaaaccccacgcagtttgtacatgcccgccgccgtggatgcttgaaccgcgtccacattggagtgcaaggcgcccaggctgtttttgagcagcgtcgagctacccgcatctggagcggcggcggccagaaacagcttctcgaccaggctgtttacaccctgctcgccatgactggcgagcgcgacggccatcgctcgcaccaaggggtagcaacgaccgccagatttgtcgccgaccgacgacaggaaaaagtcttgcggcatcagacggctgaacgtcgtgccagcccgctgaaagtcctcactgaacgtggccacctgggtcaagaccttgccaatgtactcggcttggctcgcttcggtaatgcgcccacttaatgcacccctttgcaaaggagacagtgagccgtccagaaacaggcgcttcattttcacaacggatctgtcgttgtccatccccgggattgtgatctcgcgaaagtttcgtagaccctccataaacgccgggttctgggcaccccgctgataggcttcagagatcgcgtagcgttcggtcaggctgtcgttacgctcatcccagcccccccgaatggcggcgtcgtcaatgcacaccgcagcagccgtgccgttcttggtcttgatctgctgccacagccaggtcttttccacggaactggcttcacgcatgatcgggtcgtacatcgccttgtaggattccagcgaaagattgagctgcttgatctgctcatcgattaggctggtttgggccgaaccgctgcgggtttcgcgcagttgggtgcgcttgtttaccagttgttcggtgtcttcgttgatcttggccagcacctgattacgcagcgtggtccaggccgcaatggccgaatgatgaggggaaaactcccctgtcgtgtagagaccgtcaatgaccccttcgacggatagcccaaactggactgcgacctttttcagttgttggtgaacctgttcgcggtaggcaagaaacgcgctttgcttcttctctagcacctgggcgtcagcgacgtgggtagcgatggcttcctcgccagtgcgcagttttggccagaccatctcaccgtcgcgttggtattcctgtttttgagcgatcaactgccattggccatcgatgtattgcatgtagacggctgcgagcccttcagcggtgccggaaacctggtaatcctgatagtcgacggccatgacgacgttgtcataaagcaaggagctgttaacccggccatcgtggtagacccggtaggtattggcatccagctcggtcacgattaccgagcatcccgacagtgttccggtaaacaggaaagaggccgaaggatcatgcttggcaatgtccacgtaggccggtgcggcgttggcctggttagccccgttgtatccgagaaaataggcagccacgctgacacttggtgccgttcgatccgtgtattccagctcatacagtccgggcgtgatgctcaccaactgcacacgcccctccgctggcagacgcccgaccttgaccagcgcttccgcactgattgcatgagatttggcaaagcgtgccgaatccgccaggaagtactggatgtcggggctgccctcgcgcggttcggcaccgcggctcatcgggacgaggccacccttgaggttgcgatccaataccgctcgggcaagcaatgccgggtcctgcacgtcgtacccgcgtgtttgcagcgttcgggacaaacacttctctaggggagcgccagtcagcagggactcggcgcctgctgctgcaatcagtttcgctcgcgactgaccgtggctgctggattggccctcggcggtttcagaataggcaacccctttgcccacgcggtgcatacccgccggggtatgctcaacaaatgcagtcaacggtaacgactcgttgagctgcttatgaatctggcgcgcatactccacccccgggttggaaaggtagatcacggcctggtcggtcaggatacccagctttttcggaccgatcatcttggcctgatgcaaccagcctcgattgtcgtcattgaacagttgggtcaaggcgtgggttaactgattgaaataggctttgccgacgttgatagtcagccttgcccctaccttggcgcgcccctcgtggcgttgtgcaaaatccttgggcaagaccctaaacgcttcggcattttccagaacactgttaggttgcgctgaaagggctgttttctcactgccttgcaccagaatatcgacattgacgcgagcagccagagccttgacgtaggcgacaaattcccgctgctctgtttcatcaagaccgctgaggtcggcgggtttgtcgttgctgtaacgcaggtaagcgcttttctccagcatgtcttctagactccggcgattgcccagtgccgcggaagtccactttttcccattttccttgtaattttttttgatctcatcaactaaaaacttagccttacgctggtttagatcatcaagtgctgactgcgccactttaagtagcgattgaaagctgttgctgggcatatgacactcctgaaaaacattaataaaacaatccatcagcctcgcagcagcggttgtaagacggccactgcgcgatgaatgcgataaattttcgattgtttaacacctggctgatttcaaccaatcagggctgattagagcagggctgcattgcgacgcattagcgggccgcacgttgttttgtcgacgcaagcaaactctagatacggcttacggcgcacaaaacactaagtttcacaaccactttaatactcccaccaaatcatgcgttgctctgctttttcaatcaataaaagtatgatttcggagtctcgtcgccgcctctacgcctacccccgaacataaggtcagcgcagctaagacaaggttattcctgatgtttttcggagtcatagccactgacgcgtacgccatgcagtaaaacatgaagtgttcggcaagctgagcaatgcatgcgcataggttttcgatggtcaagttcctgctcttttgggtcaaatcgaatggagtgtaaatatgttttgcacacttcaataaatgcacaataaataggttcgacattgtgttcgcattgtaaacattctgctgcttggcaggttttcaatgcttgccgtgttttacatgacaccaatgtttatcttcaatagctgagatcagcaatgcgaatacaatggacggtttcgccgaagcctatcgaacaacaaatcttgcaaaaattgaaaggatctaaaaccgttgtcgtcgtgccaaaaacatttaaatccgcacaacccacaccgtgcattattttttggttaaagtgctcaggtgtcgatataaatcctggaagtgtctgaaccatgttgcgttacttgtccagttcctagcagcggggctttcaagggggattttagtgtagactgctcgccagtggaaaggcacggctgatgggtaatgcagtgcattcgccctccagttatttcgccgcaacaggttggctgagcagcagcttttaacccctcgccaaaatgaaggaaatccctacatacgaaactttgcgcgtcatccagatttggcttgcgggtctgctcgtgagtgcagtatgtggagggtgcgatagttggtgagcatatttcgctcgagcagatctgcgccatgttcagacacacaatgacaacccagctgaggtgaaaattgtgtggatgggaagaaacatggacagacagggcgataccacccgcgcacagtggccgctctgcagcaacagtgccttacggttttttagcgttgatgaaagtttgcattgaaagtgcctgcgccacctgcttgggcctatccgatgtaaggccagcaggtaggtgaccttcctgaaggaggttgcaatgagcaaaataaaaacaacgggttgtgcttttgccggcgggtgttctacggataaataccctactgcgttatgccccgttttgccttcatcgtctacattcgaatcagccaaccatcatgacgtggctgcgccctcctgcgctttattcagtattcgcgcctggacgtcagacgagcgcggtgtctgcgaacgcgcctttaagtacggtccctttttctggcgtcctcaaacgggcgtgagcctgtctttgtggatgttttttgacgctgccttttacacaaaaggatcaagtcatgttcattgataaagtacgggtgagtgctactccattcgaggtcggcaatagcgcagttgaaaaggaacagggtcacgattgtggcaatcaaatgcagcaaccaccttcgtcggacacaccaaccaggctcgactggttagaagccgctgacgccctgcttcttcttaactcgatggtaagaagaacgcgtgtcgggcctggggcgagacccttagtacgctggtgaactgacgaaacgtttcttttttcctgtcagagcatggctgcataccatttgcggcttaggacttctcgcacatacaaaaccgcatggcgccacggcaatcatgatgcttgtcttttggctcaagtttatcaatccagtttttgatctcaattgatttcacatcggtcgcagttgaaatgtccgacttcgacaaacctgctcagtacttgagcgggcctcaatcgtgtaagggaagccgcctatgctcttcgcttcctgatgcggtctgggcggtacatgggcgcttggatactcgatcaccttgcccgcacgcgttccctcagtggagagtgtcaatagatgtttacgacgaatagattaggtttttacagtctattgctatgtgaactgtcgggcccgctgatggcggcggagcctgttcatcaaaagggcgatttctggtatctgcaaaccagcgtttacacccggcactactcgccagatcctgaccatgacaatactcagaatctgatcggcgtggagcgcaatcacgcatccggtcaggtgtggggagcagcgacctttgataattctttccatcagcgctcgtattatggttacgtaggcaaacgtttcgatcaccccacctatcccttgtacgtgaagctcaccggcggattgcttcaaggctatcacggtgaatacaagaacaaaattcccctcaaccattttggcattgcgccagtcatcatcccgtcactgggtactcacttcggcccggtagccaccgagctggtgtttctgggtttcaacgctgccatgatcacggctggcatccgcatctagaaggtgtgaaccccaacgcgcaggagcgcagagcgtatcagaatcgcaccgagttcttagacacgccgactcaccccctgccagggcggcgccgtattcagccggtcagtgcatctgcggtccggaccatgaacaagcacgcctagcattcgcactgtcatcgactacaaattccgggcaagacgctgaagcccagtgcaatgatctggccgtgctttgcaagagcctttgagtcagggcaaagtgtgtcggtcgtcgctcagcgcaaccatcaagacgacagtctgccggcggtcagtgctgaagagaccagatcctgtcatgtcgagggctggcgacgaacattgaaggattcgcctacatccagaggcgcagtgcaggcgctattgtctaagtgtgctggcggcgcaacctcggtttatcgggttgtgtttgggaaacactcgagcatctccctccccttgcttcagacgtttccatctgccggtatttcaccccgcatctttttttcgaaaagttgcgggtttttttggtcggtcgatacgctgcagaggtggccacagatctggccataaaacggcagaaaagaagcgattggcgcaatccctacaacaaaatggcgattcgccgacaagcaccccggctcaccagcgcaatagtcaacgcaacgggtcgcgttgccgggcatttcgataatgccgaagggacttgtttcgggatgcgcagctcgcgaatgcagactgctgcagagtggcggcgcaacgcgttagcttaggcaacaaagaggtcatttgggcgatgaacaaaaaaaatcaatccgactggccaagcttgctgctagtagaggatcaccctttccagttgattgctttggccatgcaattgaatcggctgggatttttctgcatacgaatggcgctggacagcgccgaagcactcgctatcgcccaggaagggcgaaaatttgatgtactggtgtgcgaccagcacctgcccgatggcctcggtattgagctgatcgatacgatgtatcgccagggcatcattgatcatgccattttgatcagtggtgtagataatccatccctactcgataatctgcagaaagtcgccaggcggcgtgggttgccactactcgcctgctttagcaagcccttgccgtctaccgatcttcttcaggcgctaagtccgttatggccctgcggccaaccggcaaaccttgaaggcaagctcaacgcctgatcggcctggaaccgtgcattgagccgccttttaggctgttggcagtgtgttcttactgcaacagtggctcacaccagtcgattgcgcttggccagctcaaccagttcaagaaaattggatacttgcagtttgagaatcaggcgtgccttgtaagtgctggcagtcttttcgctcagcatcatctcctcggcaatatccttgactcgccggccgcgggcaagctgacgcaataccgccagttctctatcagacagggactttatgagtgtctcttccgtcgccaggcgcgaagaggtatcgaccgatgagaagtcggtggttgggaaaagagtatagccggccaatacgatctgtacggcgctcagcaactcactgagattgccatctttagagacaaacgcacacgcgccagccctggaacatcgaatagcgtaccggctcagatccagataggagaagacgatgaccttgatgcggtcggattcatctcgcaggcgctgcaatacgccaaagccatccagtttgggcaggtcgatgtccaaaatgagcagatctgggatgaggctgcgagccatagccaccacctccagaccgttggaggcttctccgaccacttcatgccctgccttctccacgatcaggcgaacggccattcgtaccactgcgtggtcatcggcaattaatattctcgccaattaatttccctccccgaaatctaagcatgttggggttttcattcttatgagtgctgaatcaattaatcatcggcgatactgcctcgtgctacatcgacctttggcgtcgaggtgaggggctgtgaaatatgctcttgacggtgttcggtcttatccttgaggtctgacaagaatgcagcgagattgaggcgcgactcagtattccagggctcgcctttttgttgccattgaattaaaaatgaaagtgtcgctctaaataaataccaagcatcatcgatccaaatctaaaacgcggcatgaagtgagaaaaaggtaggcactcaatatgtttctaaacattacgcattcccgattgcagagtgaggcgtgtgtgctgccgaaggggtaatcgcattagtctatctatagactagttccttaataggcagtcgcctgtagggaaatccttaactattggtatgccagataacttaagcccaagggctgagatgtagtgatcaactaatcccggacacgacgttaagttttttctcggcctgagctggcgccagcccaccgttgaattggtgcggtcgaatccagttataccgatgcaatcaaataatggctgatgtctcggtacgcttcttgggccgtcatgtagcccacagtcggtatccattcagttttcaggctgcgaaacacgcgctccatcggcgcattatcccagcagtttccacaacggctcatggcgaaactgacggctgccatattgcgacccctgatccgagtggaacagcagcccttgaggcctgccacgctgttcgtaagccatgtccagcgccttgatgaccagatccgcatccggcttgttcgacaacgtccagcccacaactcgacgcgcgcagagatccagcacgacagccaggtaatgccatttttttttttatgggcgctttatcaacctgcggccacgatgaacgagcacggaaatggcaatagccccgaatagccccgtgctgtcccccagcgcctcgaccgggctcactcatcttcaaagatgctgaccaggcccgctcatctgtactcctgtcgaccctcaacgaaatcagcttggccagtacttcggtagatatcgcggttcgagaaggatcctgcaacacagccagcgctcttatccgccgcgttccaaactcgctctttctacacttcagcctgcggagttcccctgccaacgaccgtcgggcgggccaggtattgaacacatttttttggtaggtatagtaaccaccaaacatcacaaggaggtgatgtggacagtcggtatttgatcggccaaatcgtcgcagacggttggtatctggtcagggtcaggggcagtcaccaccatttcaagcatccccataaaccggggctggtgaccgttccccatcccaaaaaggacctgctgagaaaaaccgccatcagcattctgaaacaggcgctgctcatgtgaaggcgattcaccgcgccctggaggtttcgcacatgctttacccgattgcaatttcaatgggcgatgacgaacacgcctggggggtggaagtccccgacattcctggctgtttctcggccggcgacgacctcgacgacgccatggccatggcccgcgaagccatcgaagggcacttcgagattctcgccgaagacggtgcccccattccgcacgccaacaaggttaccctgcacgcggccaacccccggtacgcaggctgcacctgggcgctgatcgacatcgatgtcaccaaatacctgggcaaggcgcaaaagctcaacatcaccctgcccggctacttgctgaaccgcatcgacgaatacgtgctgcatcacccggaagccaagagccgctcgggttttctcgcttcagctgcactgaaggtattgcaacaagactgaacacgccgccctgaccgaagaacgtgagcggccaataaggctgttggtggccgctcaacgctggaccggccgggtggaatttagtcgtacaggtcgcccacaggcacgcgcggacgagtacggctaagcccaggtcgcatccggtgcatcggcaacgctcgaaacttctacgatgagccctcgcctttcaccgtagagaccgaccatgcgccagatcctgctcgctcccttgctcgcactttcgttggccgccggcaactgcctggccggcccttcgttcgatcgtctctacgccttcggcgacagctattccgataacggcgccagcgaccgcttgacccgggacatgctcgcccgccagttcaaggacgcccagcaactgcccggcgagctgtattggcaaggccgctggagcaacggcccgaccgccgtggaagtgcttgccaaaagcctgcgattgcccctaaccgaccacgccgttggcggcgcgaaaagcgggcagaacaattactacgcctggatgaccgcgtaccgcgacacaggagtgaacgggcagatcgacgactacctggccaacgccaaagaccaggccgaccctcgcgcgctgtacttcattttcatcagcgccaacgactttttcgagcacgccgacttcggccacaaggagccgatcgaccaactggccgccagcagcatcgaccatatccagaatgccgtcagtcgcctggccaaggccggcgccaggcatttcctggtggtcggcagcaccgacctgcgccatgccccggcggtggtggccagcgggcagagcgaacaggcgctgcactatcaacggatacttgaacggcaactgccgccgctgctggtggccgagagcaaaaagctcaatgtacaaatcacctacttcgaccatatcgccttcagcgatcaactgcgccgccggcctgccgagcatggcctggcccagctcgaccgaccgtgccagccgacctatcccgaggtgaagccagcgtgcgcccatccagacgaatatttctattgggatgaatggcacccgacccgcaaagtccatgccctggcgggcgaagccatggccaagaccctcggccaggcccgctaaggcacagcctcgccggcgagcagcaggcctgccttagacacaaagctgcaacggaaaccggttcgccccgctccaggccaggaaacgttcctgcagcatcggcctggcgaggaaataaccctgggcttcatcgcaaccgaacgtgtagagcatctgcaggcatttgaaactctcgatgccctcggccacggtgcgataacccagctcgcgggccaggctgatgatcgagcgggtgatcttctggtgctgggtgttgcgctcaaggtcggtgatcatcgacttgtcgagtttcaccacgttggccgggatctggtgcaggtaggcgaagttgctgtagccagtgccgaaatcatcgatggccacgtccatgcccaggtcgcgaatgcgcgtcaattgcgccaggacattcgggttggaacgcagccactcgccctcggtgatctccacttcgagccgccgtgggtcgatgccatgcagctcacaggcgcggcggatcagctcggcgatatcctggtcctcgaaatccttgggcgacagattgatcgacagcttgcagctctcgggcaggccccaggtgcgcaacttgctcaacaccgtgtcgatgacccagcgggtcacctgatgaatcaggccgttgcgctccatcaccggaatgaactcggcgggcgagatcggccccagccacggatgttcccagcgcagcaaggcttcggcactgacctgggctccgtcgggcagggcgaagcgtggctggaacatcaggtagatctggccactgcgcaaggcgtcgttgaggtccgaggccaggttgaacgcacggcgctgggcatgatcgcgctcggcatcgtaatgcgcccagaaactgcgcccggccatggccagctccagggcgaacatggccttgcgcaaggcatcgtccaccgactgggtatcgatctcgaactccacggttccggcgcagactgtgggaatcatgggaaaccccagcccgggcggctggcgacgcaggcgactgaccagcgcatcgagtagtctatcgagcccctcggccggcgccggcagcaggaagccgaagcgcttgaccgacacgtgatagacccgcacatgccgccccaggtactcctgcaaacgccgcgcgagaaaacggatgatggtctcgaaaggcgccagccccagggccagggtcagttcgtgggccactttcatgtccagggcatcgatcagcaccagcacgcgctgttcgccgatgtggtgctcgaccaggtcacgcaggtcgctctgaaactgctcgcgattggccaggccgctgaccgggtcgcgacgacgctggcgctggcgctgctcgacctgctccatgaccatcgccgccatatcccgcaactgctggcgttcgacgatgctcaactgctgctcgaccttgtcgatgatgcacaggctgccgatggcataaccggatgcggtcaacagcggcgccccggcgtaaaagcggatgccctgctcgcgagtcaccagcgggttgtcctggaaacgcggatcgagcgccgcgttgcgcacctccagcacttcgcggccttgcaccgtgaaggcgcagaacgactggcttatgggagtctgcggctcatcgaaacccacccgcgacttgaaccactgacgatcacggtccaccaggctgatcaaggcggtaggcaccttgaagtactcggccgccatgcggcagatccggtcgaaattctcgcaactggcggtgtccagcaactccagggcatgcagggcggccaggcgccgctcctcggcaatcgccttatcgggcatacacaacctcgggccgggataacgcgatcatcacaataaacaacctattcgcaggaaggctggagggcggcgcgacggggatgaaagcgatagtggcattaggacatcccagccaccagaatgactgacgggcaggcgcttgccaaacccatccgtcggacgaacggtattggttacaaaaaaatttggttctcaagaccttcgagctagagcgcttcgacggtttttggcgctgatctcaggcgccaaaacgagcgatcgccgcatcgatgaagtgccgcagcttggcggtcatctgccggtccggccggtacagcagatgcatggcgcgactcggcgcctcatagccgggtagcaactgcaccaactcccccgcggcccgcgccggttcgagaaaatccgccggccccaggacaatgccgaagccgtccacggccgccgacagcaaggccttgctctcgttgacgtgcaagcggctgcgcacctgaacctcctgcacctggccatcgcggcggaactgccattggttgtccgccggccgcgaccagtaggcgtaccccaggcactcatgctgttcgagatcggccggtacccgtggcgtaccccgggtggcgaggtaggcaggtgcagcgcaggcgatcagccgatagggcgccagcggcctggcggtgaggctggaatcggccagtggtccgatacgaaacgctgcctcgtagccctcctccaccaggtcgatgtagcgatcggtgaggtgcaggtcgatttccacctgcggatgctcgcgcagaaacgccgtcacgaacggcatgaggctgtaggaaccgaaggtcaccggcgcgctgatgcgcagcttgccccggggcgtggcgttcatgatctgcgccagggaatcggcggcctgggcctcgccgagaatgtgcttgcagcgttcgaggtaggcactgcccagctcggtcaggctttgccggcgcgtggtgcggttgagcaggcgcgcgcccagccgctgctccagcgccgcgacatgcttggcgaccatctgcggcgatagccccaggcgggtcgccgcacgagcataggaaccgctttcggcggccgcgacaaaggcctccatgctggtcagacgatccatcattcaacactcctagtaacaagaccaaataccagacgcttatttatcgccatctagtgtcgaatcatcatagccgctcgaccctttcaacggagcatggacatgcgtatcggcattatcggagcaggttttatcgggcgcgccgtggcacaactggccctggcggcggggcatgaggtgatgctcagcaactcccgcggcccacagaccatgagcagcgtggccagcggcattcgcggcagccgcatcggcagcgtcgaagaggccgtgcagttcggcgagctggtgctggtggccatcccgctggcccattaccgcagcctccccgcggccctgctggccggcaagacggtgctggacgccaataactattacccgtcccgcgacggccatatcgaggccctggaccgcttcgaaaccaccaccagccaactgctcgccgagcacctcgaaggcgccagggtggtgaaggtgttcaatgccatcctcgcccaggacctgctgaccgacgcccgccccagtggcgcccctgatcgccgcgccctgccgattgccggcgacgatccgcaggccaaggcgcaggtcgtgcagttgctcgacgagctgggtttcgacacggtcgatggcggcggcctggcggacagctggcgtttcgaacgggccaaaccggcctactgcatcccgctggatacaccggggctgcgcgcggccctggcgcaggcgcaacgagaagtcgaactgcccgaaggtgcgtggcgctcctgacgccaagccatgcagcgttcagcgagcgcaaaaaaaaacgacccgttcgggtcgtttttataggtttgcctgtgcgccggttcgccttctcaactggcccagccacccgcatgcaggtgccagccatcgccgcgacgctcccagaacgggtgcacataatggtacccgggacgcaacgcctcccagtgaccatggaccgccacatactgtcggccatcccagtgccagtaagcccgggaccagacataacccgggcgatgcatgggctcgacttcgatgacccgcaccggcggtggttgtggtgcaaccacctcgacgtattccaccggcgccgcgcgttcgaccacccgccgctcatgcaccacccgttcctgcacacacccggaggccactacgaccaccgccaccagagccgtgtaacgtaacaacatgctgcctccccggcgcttgacgccgacgcgtgaactactgacaacgccccctgcaaccacccggctcctgccaggcgtaagacgtgttttaacagctcgaaactgtctgctagctgaacctgatagcagcaggcagttagcggcagcaaggtggcgataaacggccagtcagcggcggcagatcagcgtcctcgggcgtcgaaatccgcccgggtcatctcgaaaaacttgctcggcagcccctcgaactcgccatcgcgcacaaaacgaaaacccagcttgcgcgccacccccagcgaggcctcgttcaaggcatgggcatcggcgacgatgcgctcgactccagccccgagaaaagcgtgctcgacaatgcgccccgccgcctcggacgcaacacccctgccccacgcccggcgcaccaggcgccagcccatttccagttccgggccgacagcatcgtagggaatgaacgacacccagccgagaaactcctgcggcgcggacttggcaaagatcgcccaatagccgcagtgctcaccaaaatcgcgctccatacgcgaacgcacgaaatcgcggtgctcctcgccaccgtcccaggggccgggaaggtaacgggtgacgtgcggatcgaggtccatggcaatgcacgcctcgaagtgttcgagggtgcgcgggcgcagcaacaggttgggggtttcgaagtggaggttcatcaactggatatccgtattcgccgagggtaaaaaacgccgcagtgaaagtagcaggctggcgtcggaatcgctggatatccgtatcagaacctccccctgacacgcagatacctgtaggagcgaagcttgctcgcgataaagtcgtcacaggcgccactgcgtccaagcagttacctcgtcttggaggccaccgacgctatcgcgagcaagctcgctcctacagatcgcggttactgcaccaacagcgcctggatatcgttgaacagcgcgcgggggatctttacgccgtgttgcgtgctgcgggccctggcttcgaaacgccgctgcgacggcagccgcgcgccctgccccgtgatggccgcgaacagtccttcggcgcgttccagacctttctcgtagtcctgccccagaaacacctgcggatcgaacgccaggatcagctcgccatgacagggcgcggcgccgacgccggcgtcgaaggccatggactcggcgctggtgaggtcgccgatcagcgcgccggccagcagttcgatcatcgccgccagggctgatcccttgtgcccgccgaaggtttgcatggcgccttgcagggctgccctggcatccgtggtcggttggccctgggcatcgatggcccagtgttcggggatggctttgccttggcgcgcgtgcagttcgatatcgccgcgggcgatggcgctggtggcgaagtcgaacacgaacggctggcccgccggccgtggccaggcgaacgccagggggttggtgccgaacaccggcttgctgccgccggccggcgccacccagctgtggctggggttcatggcgatgcccaccagtccctcggcggcgatggcctcgacctccggccacagagcggagaagtgaaaacaacgcttgatcgccatggccgccagcccctggctgcgggccttttccgccagcaatggcaagccggtctggaacgccagcagggaataaccgtagtgcgcatccacctccagcacgcccgcggaaatagaccgcaggctcggctcggccagcgggtcgaccttgccctcgcgcacggagcgcacacaacccagcaggcggtacaccccgtgggaatggcactcgtcgcgctggccctgggtgatgacctcggcaatggcccgggcatgggcatcggacaggccgtggcgggtcagcaccttgagggacaggtcatggacttcggcgagggaaagagtgacgagatcggacatggggcttgtgctccgataaaaaccgtgggggccgggaaacccggccctaggagttgaggtgagaacgctgcaggcctgcggcctgatcgcagcctgcggcagcggctacaacggccgctcgccgttgagacgctgtggaacctgccaggggttgtcgttgcgcaaagcctgcggcagcggctacaacggccgctcgccgttgagacgctgtggaacctgccaggggttgtcgttgcgcaaagcctgcggcagcagtgctggcggcaagtcctggtacgacaccgggcgcaggaaacgctggatcgccaggctgcccaccgaggtggtgcgcgtgtccgaggtggcggggaacggcccgccatgaatcatggcatggccgacttcgaccccggtgccaaaaccgttgaccagcaggcggccggccttgcgctccagcaacggcagcagttcccgggcttgcggatggtcgttgtcgctcaggtgcagggcgatggtcagctgaccttccaggctcgccagcagcgctctcatctgggccgcatcggtacagcgcacgatcaacgaggccggaccgaagacctcctcgcgcagcgcagcgcgggccataaaggcctcggccgatgtggcgaacagcgcggcacgggcctgataacgctggccatcggcgccctgccccaagggttccacctcggcatgccgcagcagccgctcgacgccctgggagtagctgccatgaatacccggcgtcagcatggtctgcgccggcgccaccttgagcgccgcggccgccgcggcttcgaatgcccgcaacgccgggctgtcgaccgccaggagcaaacccgggttggtgcagaactgcccggcgcccagggtcagggaaccgacaaaggcctgggcgatggcttcgccgcgctcggccagcgcattggccagcagcagtaccgggttgatcgaactcatctcggcatagaccgggatcggttcctcgcgggccgcggcgatcttcatcaatgccacgccgccgctgcgcgaaccggtaaagcccacggccttgatccgcctgtccgccaccagcccctggccgatgctgcggccggcatcgaacagcagcgagaacaccccttccggcaacccgtggctgtgcaccgcctgctggatcgcctggcctaccagctccgaggtgccggggtgcgccgaatgcgccttgaccaccaccgggcaaccggcggccagtgccgaggcggtgtcgccgccggccacggaaaacgccaggggaaagttcgaggcgccgaacaccgccaccggcccgatggcgatctggcgcaggcgcagatccaccttgggcaagggttggcgctccggctgggccgggtcgatgcgtgcctccaggaagctgccgtcgcgcaccaccgccgcgaacaagcgcagctggcctacggtgcgcccgcgttcgccttccagacgggcacggggcaagccggtctcgctcatgcagcgctcgatcagctcatcaccgagggcgaggatgttgccggcgatgctctccaggaacgccgcccgttgttccaggctggtttcccggtagcggtcgaatgccgtctcggccagggcacaggcgcgctccaggtcgttcgggccggcgccgccaaaccccggcgccagggcctcgccagtggcggcggccagcgcatgcacttcgccgtggccaccccgcacgcgggcttggccgatcagcagttgtcctgttacaggcatgggttacctctctgaataaatggcgtgagctgaatggatgcctgggccgtgctcattcgtctgccccttccagcaacagcttgctgcctggcaccccggtgttggcgccccagtagtaaatgcacagggccatgagggtgacgaccagggtgtcgtaggggtgagtgagcacgccgatcccgccgaagctgcccaggtaggaaatgaccatggtcagggcgtaaaaagcgatcagccacagggacgagcgcacctgttcggtcaggctcaggtggtcggtgggcaccaggcgtttgcagcccaggtagatgacgaacatcaggatctgcaggcccagcagccaggacaccgtgctccagccggaccagtagacgatcagcgcggcgatgacgaaggacaccggccccaacaggccgaagccgctgacccggaacggccgcggcaggtccggcgcgctcttgcgcagcgccgccacgctgatcggggcaatcgcataactgagcaccagggccgccgacaccacattgatcagcgcttcccaggacgggaacggcaaggtccagaacaccgacaggccgaaggtcagccacaacgccgggcgcgggatgccggactgctcgtcgatgcgggtgaagatcttgaagaaggtgccggtcttcgcccagccgtagaccacccgtggcgtggcgttcatgtagatgttgccgcagccgctgggggaaatcaccgcgtccgccaccaccaggtaggccagccagccgacgcccagggtcagggcgatgtcgcggtacggcagggagaattgcttgctgatgctgctccagccgttggccagcatatcggtgggaatgctgccgaggaacgccagttgcagcaggccgtagatcagggtcgagagcaggaccgaaaggatcagcgcgatgggaatggtgcgctgcggattgcgcacttcgctggccaccgaaatgatcggcgtcaggcccaggtaggcgaagatgatgccgccggcggagaccgccatttcgatgccggacagtccaaagggagcaaagccctggacgtggaaattttccgctttgaagaaggtgaacagcacgccgatgaccagcagcggcaccacgaacttgaacaggctgatgaggttgttggacttggcgaaggtcttgacgctggagtagttaagccagaagaacaggcacaacagggcgaactgcaccagccagccgagaagggtcgggttgctgttgccggcatgggtcaggcccggaaaccaggccgccgcgtattgccgcgccgccaccacttcaatggccaccaggctggaaaacgcgatcaacgtgatgaagcccatcaggtagcccagcagcggcccgtgggagaacaccggataacgcaccaccccgcccgctcgcggcaaggccgcgcccagttcgcaatagacgatgcccagcagcaggacggcgaaaccgccgagcagccaggagaagatccccgccggcccggcgatggccgagacatggctggcggcgaacaaccagccggaaccgaagatcgcccccaggccgatgaaggtgaggtcaaccagagagagctgtttcttgaatttgccttggcctgacataggcgcgccttcttattgagttattggagtaggcagatcgaatgtcgcgccggcctcctgcgagcaggctgccgacggggtgaaacacggcactgcgcgagtgcctgatggttcttctcgtggaccaggccgccccgcgagccactgcgcgggggcggcctgtcggctggtttacagaccgacgtccggcaactgcggacgctcggccagggccttggcgactatcgccttgacctcggccagggtctcgccctgcagggccaggcgcggtgggcgggtgatcgaggagccgcgaccgaccagttcctcgcagagcttgatgcactgcaccaggtccggacgcgcgtccaggtgcagcagcggcatgaaccagcagtacagcgccagggcctcttcgaagcgtttttccctggccaggcggaacagcgtctcgccctctttcgggaaggcgttggacatgccggagacccagccttcggcgccgacggcgatgctttccaccaccacgtcatccaggccggcgaacagcacgaagcggtcgcccacggcattgcgcaggtcgatgaagcgccgggtgtcgccggaggagtccttgaagcagacgatgttttcgcagtcctgcagagcgatcagcacgtccggggtgacgtcgtttttgtagatcggcgggttgttgtagaccatcaccggcaggtcggtgccggtggcgatggcgcgaaagtgcgcggcggtttcatgggacttggccgaatacaccagggccggcatgaccatcaccccgtcgaccccgaccctggccgcttcgcgcacggtgttgcgggcgaactcggtggtgaactcggcgatcccggcgatcaccggcacgcggccgccggcggcgtccttggcgacctcgatcaccgagagtttttccgcggtgctcagcgaggtgttttcgcccacggtgccgcacaccaccaggcccgacacaccgtcggccaccaggttgcgcataacgctgtgggtggcgtccaggtccagggaaaagtcggctttgaactgggtgctgacggcagggaacacaccgctccagtggatggctttacggctcatggtcttgtccttgtaggttgagtcggtcggggccgacaggcgttggaaacgaaaaacagattccgcctttcaccgccctggagcttgaggtttttcccgctcaagcaagacgaaatcggcacatttgcccgttcacgtacagaactttccccagtatttccccaccgaaccgccgcacaaatccccgccccagcgcgtccttgtagccgctgccgcaggctgcgatcggtcgcatagcggccgccaagccagacaacgcggtgcaacagaaatatccgggatgcaggctttgcgtctgctgcgcagccgatcgcagcctcgtacctcggcagcggctacagatgggcgagcttcatcactgtgccgatttcgtcatccgccgcagagaaaacccacaagcgatgcagccctttcccgagccaatctgtaggccttttccgtcaggtgctgccatgaaaaaaataaccgtcatcgattcacatacggggggcgagccgactcgcctggttgtcgacggctttcccgacctgggcggcggttcgatggccgaacggctggcgatcctgcaagaacgccacgatcattggcgcacggcctgcatgctggaaccgcggggcagcgacgtgctggtgggggccctgctgtgcgccccccaggcggccgatgcctgtgccggggtgatcttcttcaacaacagcggttacctgggcatgtgcggccacggcaccatcggcctggtgcgttcgctgtatcacctggggcgcatcgcacccggcgtgcaccgcatcgaaaccccggtgggcaccgtcagcgccaccctgcacgacgacctctcggtcagcgtgcgcaacgtgccggcctaccgttaccgcagcggcgtcgaattgcaactggtcggccacggcaccgtccgtggcgatatcgcctggggcggcaactggttcttcctgatcagcgagcatggccagcgcatcgccctagataacgtcgaagccctgacccactacacctgggccgtgcgcgaagccctggaggccgccggcatcagcggcgccgacggtggtgtgatcgaccatatcgagctgttcgccgacgacccgcaggccgacagccgcaacttcgtgctgtgccccggcaaggcttacgaccgctccccctgcggcaccggcaccagcgccaagctggcctgcctggccgccgacggcaaactcgcgcccggggcgatttggcgccaggccagcgtgatcggcagccagttcagcgccagctacgagccggcaggcgagcaggtcatcccgacccttcgcggcaccgcccatatcagcgccgaagccaccctgctgatcgaagacagcgaccctttcggctggggcatcgtctcgtgagccagccggccgaagccgacgtcctggtgattggcggcggcatagtcggggccgcctgcgcccatgaaatggcccgccgcggcctgcgggtgcgggtgctcgacaacgccagcggcggcgccaccggcgcgggcatgggccacctggtggtgatggacgacaaccgcgccgaactggccctgagtcactgctccatcggcctgtggaaccagctgcgcgcgcagctgccagccgcctgcgcctaccgcaattgcggcaccctgtggctggccgcggacgctgcggaaatggacctggcccgggccaagcaaatcaacctggcccagcacggcgtggcgggcgaattgctcgacagcgcgaccctggctgcactcgaacccctgttgcgcaaagggcttggcggcgccctgaagatccccggcgacggcattctctacgccccggccaccgcccactggctgttgcacaacacaccggggatcagctgcgagcgggccacggtcagcgccatcgccgaccaccgtgtggagctggatgacggccgcgtgctgcgtgccgagtacgtggtgctggccaacggtctggcagcgaagaacctgctgccggagttgccgctgcggccgaagaaaggccatctgctgatcatcgatcgttacccccggcaggtgtcccaccaactggtggaactgggctacgccgccagcgcccacgccagcaacggcacctcggtggcgttcaatgtgcagccacggccgaccgggcaattgctgatcggctcgtcccggcagttcgacagcctcgacccggccatcgagcccgaagtactgaccccaatgctgcaacgggccgtggcctatctgccgggactcgcgcaattgaacggcatccgcgcctggactggctttcgcgccgccaccccggacggcctgccgatccttggccaacacccacgccacacaggcctgtggctggcggtcgggcatgaaggcctgggcgtcaccaccgcccccggcagcggccggctgctgacccaattgctgctcggcgaacggccggatatcgacacccaggcctatcgccccgcacgcttcgccgagctgaccgcccccctgactggaactgccccatgatcatttacctggaccgtcaggcgctgaccgtgggcgatggcctgagcgtcgccgccgccgtcgccgccagcggcgacccacgtacccgaacctcctgcaccggccagccccgggcgcccttctgcggcatgggcatctgccaggaatgccgcatgaccatcgacggccggcgccaactggcctgccagaccctgtgccgcgaaggcatgcacgtggagcgcacgccatgagtcaacagcgcctgagctgcgacatccttatcgtcggcagtggcccggccggcctcgcggcggcccgggcggcgagccgcagcgatctctcgatcgtcctgctcgacgacaacccgcgccccggcggccagatctggcgcaacgggccgggcgtcacgctcgccggcatcgcccgcgacgccttgcaggtgctggagcatccgcggttgcgttacctgccgggcacccgggtggtggccggcgccggtgccaatgccctgctgctggaaaatgccgagcaggctttgctggtccgctatcagagcctgatcctgtgctgcggcgcccgcgaactgctgctgcccttccccggctggaccttgcccggcgtgacgggcgccggggctttgcaagccctgctgaaaaacggcctgacggtcgccggcgagcgcgtggtcatcgccggcagcgggccgttgttgctggccagcgccgccaccgcgcgccaggccggtgcccgggtgcaggcggtcctggagcaggccccgctggccgccctggcgacattcgccgccgggctctggcgctggccggccaagctcggccaggccgccgggctggccaccacggcctatcgctacaacgcccatgtgctcgaagccctgggcgaagatcgcctgcaagcggtgcgtatccagcagggcgagcaggttcgggaaataccctgcgaacgtctcgcctgtggtttggggctggtgcccaacaccaccctggccagccatctcggctgccagctgcaagccaacgcgattgcggtggatcgttaccagggcaccagcctcgcccaggtctacgcggccggcgaatgcaccggggtcggcggcagcgaactggcgagggtcgaaggcgagatcgccgggctggccgccagcgggcagacccgggaggccaccgcgctgatccagcgccgggcccattggcaggcgttcgccgagcgagtgagtgaaaccttcgccctgcaaccggcgcttctgcgcctggcgcgagctgatacgctgctgtgccgctgcgaggatgtgccctacgccgccgtggctggcgaagcgagctggagcgaggccaaactgcacagtcgctgcggcatgggcgcctgccaggggcgagtctgcgccacggcggcacaggccctgttcggctgggccgcgccgacgccacgagcgcccctggtgccggcgcggatcgaaaccttgctgatggaatcgccgacacccggcgcgaagtgaaacgcagaccgttgccgcgggccgcacgccaacgacgccgcgcaattcaaggatgagccagtagacccaaagtcgcggggcgcgccccgtcccacaacaagagcagcccttgatgatcgataccgctcagctgcaccgcctgcccgacgccatcgccagccaggcgcccgaggatattcacggcctcctgggcagcatggctctggtgatcccgctgctcgacaccctgcccaacgcggtgtttttcatcaaggacctgcaagcccgctacctcaccgccaacctgaccctggcccagcgctgcggcttcaagaacgtcgcgccgctgctgggcaagacctcggccgaggtgtttcccgccgtgctcggcccggtctataccgagcaggaccaacgcgtgctgcgccagggcgtcaccatcaagggccagctggaactgcacctgtacggcagccgcgaacccggctggtgcctgacccacaagctgccgctgcacgggcgcgacggacggatcatcggcatggccggcatttccctcgacctgcaggccgcccgcgacgcgcacccggcctacgaacgcctggccgcggtggaccggcatatccgcgagcactacaacgaagccatccgcctcgacgacctgacctatatcgccgacctgtcgatcgcccagctggagcgctactgcaaacgcatcttccacctcaccccacggcagatgatccacaaggtgcgcctggaacacgcctcgcgcctgctgctcggcgaactgccgatcaccgacgtcgccctgcaatgcggctacaccgaccacagcgccttcagccgccagttcaaggcgctgacgggcgtcagcccacggcagttccggcagaacgccgcgcattgagcgaagtgtttgcccaccacctgctcattcgcggtaaaaggtcgtgtacccgaacaaagtgtcgaaccccgccttccggtagatcgacagcccctcctgggaggcctccagcacacacaggctcaccccctgttttttcgcatacgccagcgcgtgtcgaatcagtgcgctggcatagccccggccctggtattcgggccgggtgccgatatcatccagacgcgccaccgcctgccccaacgacagggtcagcgaactgacgggcagcgactgctcatacaaggtgaaatgcctcaacggctggccgttttgcagcgccagccgatgccgggccaggtattgccccgctcccgcatcacccgactcgaaggcactttccacgggatcggcccaatcctcgagctgctcatcggtacggcgaatgtcgaagctcaccgccacatccggtggcaattcatggacgctcagatcgatccacatcgacgtggttctatcgccttccaacaagtgctgctccagcagcaggtcgcggacctgcgccaccaggttatcgtgcacaaccacacaaaaaggcagccccgcgcgttcaagaaacccgatgcctgcaagcacccccacggccaggtccggccctgttcgcttgacgaacagcaggttcagactgctggcgacgacacccgtgcaatacaccgcaagactatcgttaaaatgccagttttcttgtgaaatggccgagaaaaaaaggtcctctgtctgatgatagagagcgaccgtacgggactgcgtaacgctggacatcgtgttcactcctaagtctgctcgcgccccctgtgtcgcgctcttcaatccacggtaaccccgagcacccgggccctccagaaaaattctgttttagagtgtgaaggtgtgtgttcgtcgatagagcaacctgatccgctggcgcgaaaccagcctgtcgcagagcttcgaaaccgcggtggtgttctacaagttcatcagtgaccagggcaacggccccccactccacgcaaggccaccgcctgaatggcggttcccaaccccagcaacccttcggtgcccagctgtcagaaagtggacaacgactactggtcgtccgaaatcctggcctgcggcagttccggcagaacgccgcgcattgaccccgtctaccggcctacttggtccaaccccggccaaaacaggctgtggccggccagaggtccttttccctcgcaagggcacagaaggcacccggatgaatttcgtgaacgccaggacttgcgatgaattatgatgcgcgccctttcggctcgcgtttcagcgcaggctcacagcgccacccttcgttcgccatccaaggccaggaaccctgcatgcttcacctcaggagcttcacccgaacgctgcatcggcagcagatcgatggcgtgaccttccacttcgatccatcccaccggcacgaactggacccgctgctacggcgttttctggccaagcccgagcaatatcccacgctggatattccggaagacacgcggggcgtgttcctcctcgaaggtgagcgccaatgggtgctcaagcacaaccgcctgactcactggaaaaagcagctgcagaacttcctcgggctcaagcgcagcttcggcctgcacgacctgaccaatgaattcatcaacctgtcggtggtgtcgggcaaatccgccctctcgccccaggtctcggcgtttggctacaaggggcgttttccattcctgcgcgaagagtacttgctggtgggtttctgggcggaccattgcagcgtcgacgagcgcctgctggcccatcccgagcaggctgaaaccctgttgccggcgatcttccggctgttcggccagatgcttgacgacgacttcgtgcacatggacccccacccgaaaaacattctggtcgccgccgatggccgcctgcgcctgatcgacttcgagtgctgcgcccactcggtactcgaccgcgacttcagcctgggtttcctgctgggctacttctaccgtttctggttccggcgcttcatctcgcagcaggattacgaccggctttgcgaggcctacctgaacgcggagcaccccaacctggatcgcaccgtcttccagccggtgtaccagcgctttcgcgaccaaaacgtctcacgcagcatgcgctaccgcatcctcacctgcgcccgggcacaagcggcgttccagcgcgaaatcagcggctcctgaagcccgcccgctaccccgttcataccgctctcgacaagcgaaggcggggagccaggctggtagagaattgactggcgaccgaacggctgcagcccctgactgcagccagagggccaatcataaaaaagaattttccccctgccgccgctgtctgaatttcagatgccgccgcacaggggaaacgacaatgaaattcgccaaattctcgcagaagctgtcgctgtgggccggcagtccggggacctttctgattgcgctggcattgattgcgatctggggcatgagcgggccggtctttggtttcaacgatacctggcagctggtcatcaatacctccaccaccatcatcaccttcctgatggtgttcctgatccagaacacccagaaccgcgataacgacatcctgcacttgaagatcgacgaactgctgcgcgccaccaaggatgcgcacaatgcgttgctgagcctggatgggctggatctcgagcagttggagaagctacgccaggaatacaaggaaatcggcgagggcgagcccttgaagctggatgagctaccgccggagcaacagcagaagccgagttgaatcgatgctgaaaatgccagggagagaacggcgacaccggacacggtgcgccttcaggttaggcccgaaggcgcatcgatggtgggacggcactcagccatccaactgatccaggggccggccagccttgagggccttggccatttgcaggtgattctgcagtttcggcagggtctcttcggcgaaggccttgagttcggggacctcggtgatttcggcctgttgctggatctgctcgatggcttcttcggtggccttgacctggctctcggcataggcggcatcgaaggcttcgccttccggaacctcggggatcagcgccttggccttgctgatcacttcttcccggggcgctacgggcaagtcgagtttcctggcgattttcgccaggtgctggttggcggtggtgcggtcgttgatgaccacgatggtgtagtccttgaccgccttggaagaggtcttctggtgggccaggcgactggcctcgatatctgccatgcccttggccgaagcctcatcgataaactccgcaggagactgggcgaacgccgcgctggcactcaggccgagcagcagcgcgaggcaggtgcgggacagatgggtggccatgaagctcatggtgtcggcctcctttgatcagttgacggcgcacggcgcctgcacagagtgagagttttcaggccatcgaaggtttgaaaaagttgcatcggccacgacgaacggttggcaaaaaaacgccctgatcggccgcttctttcaggcccgggacgggctccgctgggcgcgcttggccgcgtacatcgcctcgtcggcgtgcttgaacagctgcttttcgtcatggccgtgttcggggaacaggccgatgccgatgctcggcagaatgctcagttgatggccatccaggcgcagcggctcgtcgagcgcccgacgaatctttccggcgacgataccggcatcttccgcatgctggatacagccgagcaacaccacgaactcatcgccaccgatccgcgccacggtgtcgctctcgcgcacgcaggccttgaggcggttggccaccgcctgcaacagcatgtcgccgacggcgtggccaagtgtgtcgttgacctgcttgaaccggtccagatcgacgtagagcaaggccatgcgcccggactcgcgacgggcacgggccagggcactgcgcaggcgctcacggagcaattcgcggttgggcaactgggtcagctggtcgtactgggccatgtactgcaggcgcacatgcagctgcttgcgctcgatggcggtggcgagctgagcgcagacgtattgcaacaactccttgtcctgctcggtgtattgctcgtcgcccggcgcgctcttgacgatcagcgcgccgatggtgcctttctgcgaattgagcggcaccccgagccagcagggcgagtacgggtcggcggcatccgacagcggtgaaagcggcccataattgccgggagtcagcagcaacggctggccactgcggatcacctcggcgcacaggctgccggtcagcgtgcccggctgctccgggcaacgctcgcggtcgtcgacgtgatagggaaagctcagcgcctggcattgctcgtcgtacagcgccacggagaaattcagcgccggcagccattcaccgatgatccggtgcacgcgccggaacaacgccagcaggtcctcggtggcatgggccgcttcggaaatcgcatacagcgccgcctgccgcgactcggcctgcttgcgctcggtgatgtcgcgggccacggcgatgcgcagctggtcgacctcggaccagcgcgccgaccagaggatatgcgcgacctgaccgtccttgcgcaggtaacggttctcgaagttgggtatggattcgccagccatgatccgctcggcggcctgcagcgtgcgcaggcggtccgcggggtgcaccagctcgatcatgcgccggccgaccagttcgtccggcgtgtaaccgaaaatccgctcgcaggcggcgctgacgaagacgaaacggccttccacatccaccgcacagacggcgtccagcagaaggtcgatgaaactggccaggggcgcggagttgttggttgccatcagggaacgacactgcctgtgaagataaagcgccgagtatcaatccctggttctggcagcggcgcagggccgctgcgggtccgtggctgtcgcaaccttgcggacagcctttatgccttgttcgccagcaatcccggaacggcatgcagcaaggcgttgatggcaaacccgatgaacatcacgccgcaaagccgggtgatcgccagttcgtggcgctgatacagggtccgcacccgccgcgcaccgacgatgccaatcagaatagcgtatgcgccgataccgccgaggaaactgaggaagatcagccagggcagcatcgaccagttgagcagctcggcgcgactggacagcagcgcggtgaacgtcgccacggccaccgggtacgccttggggttggtcaggccgaacaggatgccgtgccagaacggctggcgcgccgggccctggggttcctgcccgttgctgcgctggctgcggatcgcccgcaggccgagccagaacagataaaggccgctgagcacgccgagcacatcgaaggccgtgctgccgatctcccgcgcgccgacgatggcgatcagcgcggtgctgcaccagatcacgtcgcccagcagatgcccgcagagaaagccggccccggcccgccgcccgcgcgccgcgccaataccgaagaccgccagcacgcccggcccgggagtaatgccgtagataaagcccgaggcgagaacggccaataacagcgaagaggtcatgccacactccgaagcgccgaaggtggcgcggttttgatcgcaggattctgccggcttgcgcgcccccgcaccaccccaccagggtcgccataacgacagccagccgtcttgcagcggcggcgagcggtcattcgtcggtaaagatcgtcatcccggcatagggctgctgccggcaggcgcgcaaacgcgagaccagatcgccgacatgggcttccagctggtggccgtcggggtcgaggaaatagaacgaggcgccttcgctgcggttgtcgcgccactcccgcacgccagcagcccgcaggcgctggacgaacgccaggaaatgcccggcctcgatgctgaaggcatagtgggtgtagtccggcacttcggccgagcggcgcgacgggtccagcgacaggcacaaccacaggctcggcagcgacagataggcgccgctgtcccagctggcatccaggcgcaggcccagcaggtcgcggtagaaccccaggctgcgattcaggtcggtcacggcgagggtcagatggttgaggccggtgagcatgcaaagtccttggaagaggaaggtccgttttcctgccagtggccggttggcaagacgaccgctaatagctcgtgcattgggaccagcgctggcgcacccaggatagcaagggcccgagcgcgcggtagaacatctgtaggtatcagaacgcgttgcggaagatttcctcgatctggcgctggtcggcggtgcgtgggttggtcaggccgcaggcgtctttcagggcgttggcggccaggaccggaatgtccgccagcttggcgcccaggtcgcgcaagccgctggggatctcgacatcccgggccaggctgcgaatggcgctgatggccgcctgcgcgccctcctccgggctgaagccacggatgtccgcgcccatggcgtgggccacgtcggtcaggcgtccggcgcagaccatggcattgaagctctgcacatggggcagcagcacggcgttgcacacgccgtggggcaagtcgtagaaaccgcccagctggtgcgccatggcatgcacgaaacccagcgacgcattgttgaaggccatgccggcgaggaactgggcgtaggccatgttttcccgggcgaccaggtcgctgccgtcgtgcaccgcctggcgcaggttctggctgatcatggtcatggctttcagcgcgcaggcatcggtgatcgggttggccgcggtggacacataggcttcaatcgcgtgggtcagcgcgtccatgccggtggcggcagtcaggcccttgggcatggcgaccatcagcgccgggtcgttgaccgacagcagcggcgtgacgttacggtcgacgatggccattttcacgtggcgctgctcgtcggtgatgatgcagaaacgggtcatttcactggcggtgccggcggtggtgttgatcgcgatcagcggcagttgcggcttggccgagcggtcgacgccctcgtagtcgctgatatgcccgccattggtggcgcacagggcgatgcccttggcgcagtcatggggcgaaccgccgccgagggagaccacaaagtcgcagccgctctgctgcaattgcgccaggcccttctcgacgttgccgatgctcgggttgggcttggcgccgtcgaagatcaccgaatcgatgtcctgcatcgccagcttctcggcaatcatcccggccaccccggccttggccaggccggcgtcggtgacaatcagcgccttgcgaaaaccgtagttgcggatcgcgaccatggcctcgtcgagacagtcgatacccatgatgttcacggcgggaatgaaaaaagtgctgctcatggcgcgtcctccaggctgggattggatcagccgtgccgatccgacaaatgcgcacaggatcgacccatcggtcacgcgcgttgttgatctggctcaagggtcggtcgtgataaagtcggcgccctgtacaccttctgccttgagacgacgaatcgcgatgatggatttccaggaatttgatgccgaccttgaagactggaacgccttgcgcgccagcacgccgatcgccggcctgctgatcggcaacggcgccagccgcgcggtgtgggaagacttcgcctacgactcgctgttcgagaacgcccgcaccgtcgaagaaaaacccctgagcccctccgaactgagcgtgttcgacgccctgcagacccgcagtttcgagcaggtgctgggggcgctgaagaccaccagccgggtcaacaaagccctggccgtcagctccgcggcgccgcgcaatcgctactacgcgatcaaggaagcgctgatcaataccgtgcacgcggtgcacattccgtggcgcctggtgcggccggcgacgctgtcgcagatcaaccaggaactgcgccgctaccgcacggtgttcaccagcaactacgacctgctcaactactgggcgatccagcacgatgcccagggcatcgacgacctgttccagggcgccgacccgagcttcgacatcagccagaccgccagcgaacagacccgcgtgctgtacctgcacggcggcctgcacctggtgcgcaaccaggacggcaccgcgcgcaagctgggttccaccgagggcacgctgctgggcaacttcgccatcaacaacaccctcaagaccctcgacgatgtgccgctgttcgtcagcgaaggcccggtggcggacaagctcaagaccattcgcggcagcgactacctgtcgttctgctaccagcagttgctgaatcacagcgacgcgctgtgcatcttcggccacgacctcggctcccaggacagccacctggtgagcgccatccgccagtccaaagtgcggaccctagcgatctcgatccagccgcgcagcaaggccttcatccagaaccagaagcggcgctacgccaagctgttcgagggggtggaagtgacgctgcgcttcttcgattcgaagagccatgcgctgggcgatcctgcgctgtcggtgccggtcgaacgctgaaagatcgcgggcaggcgtctgcggagcgccacctctgtagccgctgccgagcctgcgaggctgcgatcgaccccgaagggggcgcacggtgttgagatctctgaaggccttcggccttatcgcagccttcggcagcggctacatcgtgtcccttattcctcgccgctgtgcaccaccaccagcaactgcgcctgcacctcgcccaccgagcgcaggcggtggggtttctgcgcgttgaagtgcagcgcgtcgccccggttgaggatcacccgctcgttcatgaaatccacttccacctgcccttcgtggacaaacaggaactcctcccccaggtgttccttgaagctcttgtcggtgaactcgctgggcgggtagatgatgaacggcaacaggctgcgctcgctgacctgatgcgccagcaccgcataacccggcgcctggtcgttggccgccagcgactggcgttcgtcgctgcgcaccaggctgtagctgtccaggctgaccttgtcttcggcgaacagctcctcgacgttcacgttcaacgccctggccagtttcaacgccgcggcgatcgagggcgtgttcaggccgcgctcgactttcgacaggtagctcttggtcatgccggatttctcggccagggcctccagcgtcacgccaagtttttttctcaataatttcaaacggatagacatgtagaacggttaacccatcaaggaggcgacgatttgtccttgccaatgacacaaagtgtcatatagcctctttagtgtcatttgctttcacccaacgaccttgcgagcagcgggagctggcaaatccgacgtccattgcaacgaccaaaggacaccgacatggccaagacattagcactacccaaagagcaactggtcaggcaagccctgacccagatgcaaaacaccctggcggataatacgtggaccgaccggcaaaagctggccctgacttgccgcatcctgttcgagaacggtcacgactccggcctggccgggcagatcaccgcccgtggcccgcagccgggcacttactacacccagcaactgggcctgggtttcgacgagatcaccgcgggcaacctgctgctggtcaacgaggacctggaggtgctcgaaggtcacggcatgcccaacccggccaaccgtttccacagttgggtgtaccgcgcccgccccgacgtgaactgcatcatccacacccacccgacccacgtcgccgcgttgtcgatgatcgaagtgccgctggaaatctcccacatggacctgtgcccgctgtatgacgactgcgcctttctcaaggcctggccgggcgtgccggtgggtaacgaagaaggcgagatcatctccgcggccctgggcgacaagcgcgccatcctgctctcgcaccacggccagctgtccaccggcgccagcatcgaggaagcctgcgtgatcgcccaactgatcgagcgcgccgccaagctgcaattgctggccatggccgccggcaccatcaagccaatccagccggagctcggccgcgaggcccatgactggatctccaagcccaagcgtcacgccgccgccttcaactactacgctcggcagaacctcaagcaacacgccgattgcctgaactgaacccacctcattcgctaaaggagcgtcgccatgtcgaacgccaacattcacggcatcatcggctacaccatcaccccgttcaccgccaacggtgagcaactggacctggacaccctcggccgttccatcgatcgcctgatcgacagcggcgtgcaggccatcgcgcccctgggcagcactggcgaaggcgcttacctgagcgacgccgaatgggaccaggtcgccgagttcagcatccgccacatcgccaggcgcgtaccgaccatcgtcagcgtttccgacctgaccaccgccaaggccgtgcgccgcgcgcggtttgccgaggccaagggcgccaatgcggtgatggtcctgccgacgtcctactggaagctcagcgaagctgagatcctcgcccactaccaggccatcggcgacagcgtcggcgtgccgatcatgctctacaacaacccggccaccagcggcaccgacatgtcggtggaactgatcctgcggatcttccatgcggtggaaaacgtgaccatggtcaaggagagcaccggcgacatccagcgcatgcataagctgcagctgctgggcgaaggccaggtaccgttctacaacggttgcaacccgctggccctggaagccttcgccgccggcgccaagggctggtgcaccgccgcggcgaacctgatcccgcagctcaacctggacctgtaccaggcggtgctggacaacgacctggagcgcgcgcgcgaactgttctaccgccagttgccggtgctcgacttcatcctcaagggcggcctgccgaccaccatcaaggccgggttgaacatgaccggtctgcaggtcggcgacccgcgcctgccggtgttcccgctgaatgaagccgggcgcaatcagttgcaggccatgttgaacgcagtgcgctaaacgccctgccgcccccctgtaggagcgagcttgctcgcgatgaggccggtagctgcaccgcctgatcctcgagttcttatcgcgagcaagctcgctcctacagcacaggacagcgcccaacaaaaagcccggcaggttgtcctgtcgggcttttttgtttcaatgcagaacgtcaggcggtcttgtctttgatggtcgtgctcggaccgttggtctgcacgctggcaatgcccgcgtcgcgcgccgcctcggacgaatagcgctggctattgccgatgatctggtggttcgcggccttgaggttgaaataaggtttgccgtccttggagacttccttggcgtagcgggcctcgttgggactgttggtctgcaccgaagcgatgccgttttcggcggcgccgcgggaagcgtacaactcactcgtcaaaatggtttcagcattgccagccttgagaacgaagcggaactgcccgtcactgcttttgctcaattcataccatccagccatggtcctgctcctgagtgtccaaagatgcgaatgcacttcggattaaagcctgtctttgccggtttaccagcgttttggggtgtgttgctgaggcacgcagcatcagacaggaaaaaccgcatccggttcatgatgcgaaactcatgcagacaaatagtaataattctcgatatcattcgcgacctttctgcccggcagcccttgcgaaggattttcatgtctcgcttcaagcccgaccccacctcggcggaccccgtccgcgggttctatgcggacatcctgcattacctgcgtaaacgcacggacaacgccagcgatgcggcggacatgacccaggacgtcttcacccaatggctcgactaccgcgaccgggccaaggtcgaacaaccccgcgcctttctgttccagatggcgcgcaacctgctgcgcgatcactggcgccggcagaaggtcaggcacaaggtgcaccacgaacaacaggcagcagaacccgagccactggccgatgaacatcacgagccactgcccgcggcccagcgcctgcaacgcctggagcgcttgaagagcgtgctcgccgaactctcgccgcgccgccgcgaagcccttatgctgcaccgcttcgaaggcctgagccaggcgcagatcgccgaacgcatgggcatctccctgagcatggtggaaaaacacatcgcctttgccctgctgcactgcaagcagcgcctggaacaggaacacggcaaggagcaagcgcaatgacccgcccccgcgcccctcaacatgagcacgagcacccgatcgacagcatcgatgcccaggcggccggctggttcacccgcaatcgcgacgatcgcagccaggccacccgcgacgccttcaagacctggtcccgcgaaccggcccatgcccgggcctacgccgagttcgagcgcttgtgggccgacctggccgaactcgaaccactgaaccgaccgacgccgctgccgctgcgcaaaaagccgcgctggcgcccggccctggcggtcgccgccgcgttggtctgcgcgctgctggccatcgagctgggcgccccgccggcgatccattcgcaacagatcgtcgcccagagcacgggcatgcgcagtttcaacctgcccgatggcagcaccctgtacgtcaacgccaacacccgcttgcgcatcgacttcaccgcgcagcagcgcaacctctacctggaccagggccagctgtacctggaagccgccgccgacaaggaacggccgctgtgggtgcatgcaggcaacgcccgggtgcgggtggtcggcaccggcttcgatgtgcgacgcggcgagaaacaactggtggtcagcgtcgcccatggccaggtggcgttcattcccgatgcgcagaagcccgattcactgctgctcggcgcccgccagcgcggcatctatgactacgccagcggcaccctgcgggaacaggcggtgaacctcgatgaggtcgccgactggcggggcggccacctggcctttcgcaatcgcgacctggccagcctggtggacgagctgaacctctatcgccgccagccggtgttgctggccgatggcgcgctgggcaacttcaaggtctcgggcaacctcgatgtgcaggatccggacgccctgatcaaggccctgccggcgctgatcccggtgaaaaccgtggccctggccgacggccgcgtgcgtatcgaagcccggcgctgaaacccatatgcgaatattttgcattcgcatatgaggttttattttgctgacgcgtcttcctccggtctgcgttgtttacgcacaccttttctggcctttgtcgccgctccgggggatttcatgtttcgcgcgccttatcacttgcagctcatctgttcgcgtccgaccctgctcgccacctgcctggcgttcagcctgcaggcccaggcccaggttcaagtcgaatcgttcaactttgccctgcccgcccaaccgctggcggcctcgctgagccaggtggcgcagcaggcgaagatccagttgctgttcgacgaagagttgctgcgcaacgtgaaggccccggcgctgaagggcgatttcagccccgaggcagccatccggcaactgctgggcggcagcgagttcagcctggtcaaggtcgaccagacctacgtggtgcgccccgcggaaaacagcagcacccgcagttcggcgctgcagctgggggccatgagcgtcatcggcagcggcctggaagtggactccgccacagtcggccgctcgaccctgaaccaggccgagatcgatcgccaccaggccaccaacattcccagcctgatcgccaccctgcccggcgtcagcctcggcggctcgctcaagcccggcggccagaccatcaacatctggggcctgggcgacgccgaagacgtgccgatgagcgtcgacggcgcgaccaagagcggcttcgaacgctaccagcagggctcgatcttcatcgagccggaactgatcaagcgcatcgaagtggaaaagggcccgcactcgcccgagaccggcaacggcggtttcggcggcaccgtgcacatggagaccaaggacgcccccgacctgctgcaggaaggccgcgacagcggcgccatgctcaagtacggctacagcagcaacagccatgaacaggcctacaccggcgcggtgtacgggcgcacccaggaccggcgtttcgatgccctggcctactggaccaagcgcgacggcgacgacatgaaactggccagcgcccagccggacccgcgcaatgcctatccgatcaaccccaagcgcctgcccaacaccgcccaggatctggagggagagctgttcaagctgaacatgcaactgaccgacgaacatcgcctgggcctgagctacatgcgttccaacagcgatatctgggcgcccttctcggccaagagctacccgacgccgccgacccagaacgatatcgacaagtacggctacgacggcgccacccggcgcttcctggcccagcgcaataccgtcgacaccacctggcaggccaagtaccagtacacgccgctggacaacccgtggatcgacttcgaggccaagtactccgattccaagaccgaccagaccgacgagcgcggcccgaacgcctacacccagcccgcctccggtggccgcaagatcaccgtgggttacgaggacaggatcctttcgctgaaaaacaccagccgcttcagcaccggcccgctggaacatgccctgactcatggcatccagatccgcaagcacacccgcgaagtggacatgtggatgccgggcaagacctatgaggtacccaagtacaacaacgggcattaccagccgggcttcatgccccatggcaaggtcgacaacaacgccttctatatccaggacgccatcaccctgggcgacttcaccctgaccccgtccctgcgctacgaccatgtgcgcaaccgtgggcagaaaaacgacgcgccgatctacaacagccccgacccggtggtcggccacgactatggcgacaagacctacaccggctggtcgccacggctgtcggcgttctggacggtcaccccgcaattcgccctgttcgccgactacagcaagacctggcgcgcgccagtgatcgacgagcagtacgaagtccaggcgccgggcaccacccgctcggccaccagccgcgacctcgacccggagcgcatcaccgcattgcgcgccggcaatatcaccagcttcgccaatgtgttcagcgatgccgatagcgtgcagatccgcaccacggtgttccgcaaccagatcaaagacgaaatcatgaagaacctggggatcggctgccccgagcagttgagcggcggcaagagcattggccaggtgtgcaaccagccgaccatcggggtctaccgcaatatcggcgacctgacgatcaagggcttcgaggtcgagagcttctacgattcgacctacctgttcggctcgctgtcctactcctggatcaccggcaagcatgaaggtgcctacaccaacccctgggggccgaatgtctgggcgcgggacattccgccgcgcaaatgggtcgccaccctgggggtgaaaatcccgcagtgggatgcgcaagtgggttggcagggccagtgggtacgccagaccgaccgcgtgccgagcgacgtctacccgagcggcccggccagcgccttgggcgactcctactgggaccagtacgagaacgaccgctacaacgtgcagggcctgttcgccaactggaaaccgcagcagccgtacctcaagggcaccgaggtcaacttcaccctggacaacatgttcaaccgcgattaccgcccgcccctgagcggcgaaaacgcctccagcctggggcgtaacgccaagatcagcgtgacccggttcttctgaaccgggggcgctgtccctataaccgctgtaaccgctgtaatccctgcaatcgctgtaacccctgtagccgctgccgagcctgcgaggctgcgaggctgcgatcgacccgaaggggcgcggcgatcttgcgaccgtctgaggtcctgcggacctatcgcagcctcgcaggctcggcagcggctacaggtattggtcagggagaggtgctggacggagaagaagtttcgctttgttttgtaaggtatttcctagaaaatccccaacgcctttgagcgccttgtacccctcaaatcgatcaggcagtctgcctgggtcgctgcaaaaacagtggcccggatgtggaagtccggatctgaagaacgtgcaattcgctcaatacgaacatcagtaactttcggtgctggtgaagtcgttttatggcggctgtacgtggggcaccctcgggtgcgccggctcttcagtcccggtcttccacacccacgtacggctgccaccttctcatgtggaagtgagatccggcggttccttgaacgactggagaaatcacctcatgaaaaagctcgtccccgatccacccctgcaatcccctcgcaaactgcgcgacccggaactggatcgcgccaacgccagcctgatcgccaccttgcaaggcactcgccgccgcccctttggcctgcgcgatggccagggcaatccgctgttcgccgtgcagcccggcgtcaatgccgaagacgcgctgatgcacgtgtccctgctgctcaaatgcgccgaggaggtgtccgatgaaatcaccgaacgcgccagcggtatcgagcgcgggctgatctggtccatggtgcattcggtggaaatggcccgggcagtggtggacgccctgctcgacggcacccgcccgacctcttgacctgaaatgaatcctgtagccgctgccgcaggctgcgataggtccgcaggacctcagacggccgcaagatcgctgcgccccttcgggtcgatcgcagcctgcggcagcggctacagggtgcgaggttatttggtggcgctgcgcaccacgctgagttccggcgtggcgctacggcgctggctcaggtagcgggtgcagctgacccgcaggaacgaggcgaaattcaccacttcgccgcggtagtccatcacctcttcgtagagcttggcgatcaactggttggtggtcatgccatcgacctcggcgatttcgctgaggatgtcccagaactggttttccaggcgcagggtggtgaccaccccgcagatgcgcagcgagcgcgaacgggactcgtagaggatcgggtcggctttgacgtagagctcgcacatgctgggtgctcctcggttggaggtaggacgatggcgctgcttcctgacagaaaagcagcgccagcaagtcatccgtttacagggtgattttggtgcccagcaggccgaggaaaccggccagccagctggggtgcgccggccaggccggggccgtcgccagattgccttggacgtggctgtccgtcacgggaatatcgatgtaggtaccgccggccaggcgcacttccggggcacaggccgggtaggcgctgcactcgcggccttcgagaatgcccgccgcggccagcagctgggcgccgtggcagacggcggcaatcggcttgccggcctggtcgaaggcttgcaccagttgcaggactttttcgttcaatcgcaggtattccggggcgcgaccgccggggatcagcagcgcgtcgtaatcggcggcctcgaccttggcgaagtcgaagttcagggcgaactgatggcccggtttttcgctgtaggtctggtcgccttcgaagtcgtggatcgcggtgcgcacggtctgcccggcctttttgtccgggcacaccgcatgcacggtgtggccgaccatcagcagcgcctggaacggcaccatcacttcgtagtcctcgacgtaatcgccgaccagcatgaggatttttttcgcggccatggagatgactcctcttcaagggaaaacaggagtattcaaggtagtccctatccgcggggccgggtaataacccggtactacgcctgcaacgcgtccgtacatcgcgtcatcgttcatcgcgagcaagcttcgctcctacggaagctgccgcaggctgcgatcggcaccgcaggggccgcaaaaccaggcaccgcggtgcatctgcgcgatggagtggggccgcccttgccccggctgcgccgccgttcgcagcctgcggcagcggctacagggtcagcccaggtagccgtcggcccgcagcagggtttccaggcagtgctcgctgatgtggtagaaggccttgagctcgccgatcttcgtcagcagttgggtcggatcctggggctcggcgcgtttgaccgcgaggatcatcttgtttttgttggtgtgttccagggagatgaactcgaagaccttggtctcgtagccgcaggcttcgaggaacagcgcgcgcaggctgtcggtgaccatctccgcctgctggcccaggtgcaggccgtattgcagcatcggcttgagcagcgccgggctctgcatctgcgggcggatctgcttgtggcagcacggcgagcacatgatgatcgccgcgccggaacgaacgccggtatggatcgcgtagtcggtggcgatatcgcaggcatgcagggcgatcatcacgtccagttcgctcggcgccacgctgcgcacgtcgccgcatttgaactccaggccctgatggtcgaggcgcgccgccgcggcgttgcacagggtcaccatgtcttcgcgcagttccacgccggtcacctgcccttgcgcctgcaaggtgttgcacaggtagtcgtggatggcgaaggtcaggtaacccttgccggagccgaagtccgccacccgcaccggctgttgcaggtcgatcggcgacgagctcagcgcatggctgaagacctcgatgaacttgttgatctgcttccacttgcgcgacatcgccgggatcagttcgtgctgcttgttggtcacccccaggtcggtgaggaacggccggctcagctccaggtagcggttcttctcgcggttgtgctcggcggacggcacttcgcgctgctgctgggccttgcccttgaacagcgaactcttgcccttcttgctgtattcgagctgcacttcatcggtgagcgacagcaggtgcgcgttcttgaacgacgccggcagcagcccggcgatcagcgccacgccttcatcgagggagaaattcttggtgatgtcgcgggtcttgtagcggtagacgaaggacaggcacggctgctccttgaccgtcagttgcttgatgatcagccgctgcaaatccgcctcggcccccacatgcttggccagcaccagtttgataaaggcgttctgcgccaggctggtttccagcagttcgagaaactgggcgtgatgatccggcgcgaggctggcgggggttgcggttgcggacatgtaaaaggtgcctcgggcgatgcggggtgtgaatcggggaatggcgggtattttaggggggatggcccgccggggcacggagttatttacccggcggcgcagaattccaggcgatggggcctcctgtagccgctgccgaaggctgcgatcggccgaaaggccgtggcgctctcaagatcgctggaggtcctgcggaccttgcgcagcctgcggcagcggctacaggagcgggggaaatcaggccaggaccaccaggcggttgggcagttcgttgcgcacatgggtcaccggcacatgcaccttgagcagttcgccgcaggcctcgatgcagttgatgaagccttgcagggtctgcccctgcttcacctgctgggtgaaggcctggacaatggcgtcccaggtcttgtcgtcgaggcgcctggaaatgccctcgtccaccaggatctccacataacgctcggcttcgcagacgaagatcagcattccggtgctgccgacggtgtggtgcaggttctgttcgagaaactggcggcgggccaggttcgaggcgcgccagtggcgcaccgagcgcggaatcaggcgagtggtgatccgcggaatgcggaacaccaggcagagcacgataaaggtcacccattgcaccagcagcaacaggtgcatgctcatccagccggtggcgtaatgcaccacgcccggcacgatcagcgccagcaggctggcccagagcaacgggatataggcatagtcgtcggcgcgggcggccagcacggtgaccagttcggcatcggtctgctgttcgacccgggcgatcgcctcggcgacctgccgttgttcgtactcactcagtagtgccatgtcttcccatactcatcgattattgttagtcaccagccgcctgacgatccgccgccgccaaaactaccaccgccgccgctgaagcccccaccgcctccgccgccaaaaccgcccccgccaaaacctccggaaccgccacgcccgccgccaccgctgggcaggatgccaagcaactggcagacgaagatcgtcacgataaacagcagtaccaggaacaccagcgcgccgggatgccgctcgaagaactcactgccacgctcgccgccaccgtcataggctgcgctcggttcgtccagtggattgccgcccagcaccagcagcatggccgatacgccatcgctgatgcccttgctgaaatggccggccttgaaggccggggtgatgacctggttgatgatcacagaactttgcgcgtcggtcaggcgatcttccaggccgtaaccgacttcgatgcgcagcttgcgatcatcgcgggcgacgatcaacaaggcgccgttgttcttgtccttctggccgatgccccagtagcgccccagctgatagccgaagtcctcgatgctggtgccttgcaggtccggcagggtcacgaccaccacctgctcgccggtggactgttcgtgggaggccagctcctgggtcagttgctggcgcaccgccggctcgatcatctgggcgttgtccaccacccgcccgctcagcgccgggaacttcagctcggcctgggccgttatcgccaatacccagagcaacagcaccacacccactctcaacacgcgcattggaacctcatccgtggtaacgccggggcggatcccgcggtcgctcgcacgatccgcgggtagccgctgccgatcagaacttcacttgcggcgctttgtcggcgtcggggctggtggcctcgaaggtctcgcgcaccggcaggttgctgtacatcacgctgtgccacaggcggccggggaaggtacggatctcggtgttgtacttctgcaccgcgaggatgaaatcgcgacgcgccacggcgatgcggttctcggtgccttcgagctgcgactgcaaggccaggaagttctggttggccttgaggtccggataccgctcggacaccaccatcaaacggctcaaggcgccggtcagctggtcctgggcctgctggaactgcttgagtttttccgggttgtccagggtgctggcatcgacctggatcgacgtcgccttggcccgcgcctcgatcaccgcggtcagggtctcctgttcgtgcttggcgtagcccttgaccgtttccaccaggttggggatcaggtcggcgcgacgctggtactggttctggacctgaccccaggccgccttggcctgttcgtcgagggtcgggatgttgttgatcccgcagccgctgagcaggctgccgagcagcagcaatgccatcacgggccagcttgagcgaaggctctgtcgtacgttcatggtggtgacgctccttgcaacctaggggatggaacctgtaaccctttgaatcgagtgcatcgggcataatctgccgccaccactggattgcatcgggccaatcggctaaaagatgcccagcgcgaaaaagagttcagaagtgtgctgcatttatccgaacaacaatagtcgttcctttattagccgctctcccaattttcggccgctcgacgcgtactgatcgtgtctgttttaggccctagagaacaatattcatgaagaagctgtgtttgctgggtttgctgatcagcctggccagtcaccctgccctcgccgccgccacgccggtatcggcccaggaaaaacccttttcggacgcagtcctgcagaacaaggacgccttcatcgacaacctgctcaagcagatgaccctggatgaaaagatcggccagttgcgcctgatcagcatcggtccggaaatgccccgcgagctgatccgcaaggaaatcgccgccgggcgcatcggcgggaccttcaactccatctcccgcccggaaaaccggccgatgcaggacgcggccatgcgcagccggctgaagatcccgatgttcttcgcctatgacgtgatccacggccaccgcacgatcttcccgatccccctggccctggcgtcgagctgggacatggacgccatcggccgctccgggcgcatcgccgcccgggaagccagcgccgacagcctggacatcaccttcgcgccgatggtcgacatctcccgcgacccacgctggggccgcacctccgaaggcttcggcgaagacacctacctggtctcgcgcatcgccaaagtcatggtcaaggcctaccagggcgacagcccgaagaacgccgacagcatcatggccagcgtcaagcacttcgccctgtacggcgcggtggaaggcggtcgcgactacaacgtcgtcgacatgagcccggtaaagatgtaccaggactacctgccgccctaccgcgccgcgatcgacgccggtgccggcggggtgatggtggcgctgaactcgatcaatggcgtgccggccacctccaacacctggctgatgaacgacctgctgcgcaaggagtggggcttcaagggcctggcggtgagcgaccacggcgccatcgtcgagctgatgcgccatggcgtcgccaaggacggccgcgaagccgccaagctggcgatcaaggccggcatcgacatgagcatgaacgactcgctgtacgccaaggaactgccggggctgatcaagtccggcgacgtcagccagcgcgacctggacaacgccgtgcgcgaagtgctggccgccaagtacgacatgggcctgttcgccaacccctacctgcgcatcggcaaggccgaagaagacccggccgacaccaacgccgaaagccgcctgcaccgcagcgatgcccgcgatgtggcgcgccgcagcctggtgctgctgaagaacgccaatgaaaccctgccgctgaaaaaggccggcaagatcgccctggtcggtccgctggccaaggcgccgatcgacatgatgggcagttgggccgccgccggcgtgccggcgcaatcggtcaccctgttcgacggcatgagccgcgccctgggcgatcaggcgcagctgatctacgcccgtggttcgaacatcaccgccgacaaggcggtggtcgactacctgaacttcctcaacttcgatgccccggaagtggtggacgacccacgcccggcccaacagttgatcgacgaagcggtgaaggccgcgcagcaggctgacgtggtggtggcggcggtgggcgaatcgcggggcatgtcccacgaatcctccagccgtaccgacctgcacatcccggccagccagcgcgagctgatcaaagccctcaaggccaccggcaagccgctggtgctggtattgatgaacggccggccgctggcgctgctcgacgagaacgagcaggccgacgcgatcctggaaacctggttcagcggcaccgaaggcggcaacgccatcgccgacgtgctgttcggcgactacaacccgtccggcaagctgccgatcaccttcccccgctcagtggggcagatcccgacctactacaaccacctgaccattggccggccgttcaccccgggcaagccaggcaactacacctcgcagtatttcgacgacatcaccggtcccctgtttccgttcgggtatggcctgagctacaccacgttcagcctgtcggacatggccctgtcgtcgaccaccctgaacaagagcggcaagctcgacgccagcgtgaccctgaaaaacaccggcaagcgcgacggcgaaaccgtggtgcagctgtatatccaggacgtcgccggctccatgatccgcccgatcaaggaactgaaaaacttccagaaagtgcaactcaaggccggcgaacagaaggtgatccacttcagcatcagcgaagacgacctgaagttctacaacgctcagctcaagtacgccgcggaaccgggcgagttcaaggtcgagatcggcctggactcccgggacgtcaagcaacagagcttcgaactgctgtaacccctccctggctcgctcctatcgttcttgtaggagcgagcttgctcgcgaaaaccatcgcccagctcctgcctctccccagacaggccaacccaccgagtcggactcgctccaagtgcctgtccgacggacgagcgctgcgcgcccgatcgcgagcaagctcgctcctacagagtcggcacagtctccgcagaagcgtgcttgctcaggccaaggcggactcagtcgcggcgattgagcaggttgaccaccagccggtccacccagccccagatccgctgcttgacccgccgccacagcgggcggttcttccaggcttcgaggctgacttcctggctctggtcgaagtcggcgaggaagcttgcaaccaccgcatcggtgagcggcatgtcgagggcttcgaggttggcctcgaggttgaagcgcaggttccagtgatcgaaattgcacgagccgatgctcacccaatcgtcgatcagcaccatcttcaggtgcaggaaacgcggctggtattcgaagatcttcaccccggcccgcagcaggcgcgggtaataacgatgcccggcataacgcaccgacgggtgatcggtgcgcggcccggtcagcagcaggcgcacgtccactccgcgcccggcggcacggcgcagtgagcggcggaccttccaggtcggcaggaaatacggggtcgccagccagattcgccgttgcccgctgttcagcgcgcgcaccagcgattgcagaatatcccggtgttgccgggcgtcggcataggccacccggcccatgccctcgccctgggccggcacccgcggcaggcgtggcaagccgaagttcgacgccggcttccaggcggtgcgatggcggttggcgatccactgccggtcgaacagcatctgccagtcgagcaccagcgggccgctgatctccaccatgacttcatgccagtcgcagctgtcctgcagcgggttccagaattcatcggtcaccccggtgccgccgaccaccgccagctcctgatccaccagcaacagtttgcggtggtcgcgatacaggttgcgcaccccgcggcgccagctcaggcgattgtagaagcgcagttcgaccccggcgcccgtcaggcgctggcgcaggcccagggtgaaggccaggctgccgtagtcgtcgaacaggcaacgcacccgcaccccgcgctccgcggcctgggtcagggcctggaccatggcttcggcacaggcgcccgcctccaccaggtacagctccagttccacctgctcacgggcccgggcgatcgccaccagcatccgcgggaaaaaactcggaccgtcgatcagcaactcgaagcgattgccttcacgccagggaaagaccgcgcccgccatatcagcgcgccgtgaagatcagcaccgcacccaccggcaccgacagactgatcgccgacaggccggccgccttgcgcagggtctcgagccccggcaccaggtcgaaatcggcggcgttgagcaccagcggctccagggtcaccacctggaaacgccgatcgtccagacgcgtggccagcagttcggcgctgtattcgtgctgtttgccgtgcagggtgacgttgaccggcagacgcaattcgatctgcgcgccaggcgccaggtcgttgatcgggcgcaggttgatctgtgcgttgatcagggcatccggatgccgctcgatttcgaacagttccttgcgcatgcgctcgtcgcgcagcggaatcccgctgttgatcgagtccagctcgacttccagctgcgccatgcccttggcgtcgaccttgccgtgcaggaccaggaaacgatggacttcggaaacattggcgtttttggtggtgacgaacgacaggcgcgaggactcgttgtccaggtaccagttggcctgggccggccaggccgcgcaggccagcagcaaagcgcccagggccttggggaaagaagcgttgaacatggaagactcatggggtcgagaaatctgagccgaaccttaaccggcccgcgcgcgcttgcaaacagcgaccagcgccgaacggtgaattccctagccgctgccgcaggctgcgaaaggtccgcaggaccttctgcgcccgcgagaatgtcacggccgtgccggccgatcgcagcctgcggcagcggctacaggctgcgctcgacatcgtggacagtcgccgcgaggctgtccaggtgcaaactcagcacccgctccaccggcgcctggtccatcggccagtgcagggccatgctgcccaccagccggccctggtcacgaatcggcaaggccacggcgcgaatcaggaacggcaaccgcaccgggtactcccaatacccctcggtacgctggccgaaaccctgatgctgggattgctcgcaggcgcggtactggtcctcctggggcacccgctcgcggacggccaggcgctggacctgctcgtgatccagctcggccaggcacgccttgcccatcgccgaatggaacaggctcgaatagtggccgacgatctggcagttatgcggataccgcttgcgcagcaccgccgggatcgaactttccatgacctccaggcgctcgccgtcgaaacacgacaggtcgaccaccagcccggtgcgctcgctcagcgcctgtaaccagggcgcggcgcgctccaccagttgccgcttgaagcgttgctgctggtcgccgaacagccgcctggcgcacagccggtagcgccggtcgctcagaccgcgatagatccagccctgctcctgcaacgtcaggagcatgcgcgacaccgtggccttgggcagcgccgtcaggtagtgcagctcctccaggcccagggcctggtgctggcccagcagttcgacgatcgccaaggcccgttcgaccgaacgcacactgccggtttctaccttgctggccatatgccgacctccctgataagcggatggatgagcgttttacgcagcaagatgcgggcccgataaacccgcacaccccggttcgagggttacaacggatgacccggcggccggcgcctgacccactgcgtcagttgttcgtgggcatgaccgagctgcaacaccgcccggtcggcctgggccggaccgatgatctgcatgcccatgggcaagcccgccggattgaagccgaccggcacgctgaggctcggcaggccggccagggtcgggccgatcaccacttccatccagcgatggtaagtgtccatttcccgccctccgacaaggcgcggccaaggcacccctgcatcgaaagggaacacttgggcgctgggcaacagcaggaaatcgtaacgttcgaacaatcgctccagggcccggtaccagtcgctgcgaatctgcgaggcctggtagacatccgccgcgctcaggcgcagcccgccctcgacttcccactgcgcctcgggtttgagcaactgacgcttctgcgggtcggcatacagcggccccaggttgccctggaccagccaatgccggtgcaccagccagcactgccacagcgccgccatggaaaacgccggctggcaggcctcgacctcgcagcccagctggcgaaaatcccccagcgccgactcgcacagcgccaacacgccatcgtccatggccagatagccgtcgtagtcccccagccagcccacacgcgtgccgcgaaagtcccgctgcaagggctcgttgaagatcgccgggtcgtccttgagcgataagggcacccgcgggtcgtacccggcctgggtggccagcaggcgcgcaatatcggccacgctgcggcccatcggcccctcggtggccagttgctggacgaacagctccggcgccgggccgtggggcacccggccgtgggacgggcgcaggccgaagacattgttgaaggccgccgggttgcgcaacgagcccatcatgtcgctgccatcggccaccggcagcatgcgcagcgccagggccaccgccgccccgccactgctgccgccggcattcaacgtcgggtcgtaggcattgccggtggtgccgaacaccttgttgtaggtctgcgagcccaggccgaactccggcacgttgctcttgccgacgatgatcgccccgctggcccggacccgctccacgcaaatggcgtcatggaccgggatctgttcggcgaacagcggcgagcccagggtcgtgcgcagcccggcggtggccgccaggtccttgatcgcctggggcatgccgtgcatccagcccagggactggccccggtccagctggcggtcgcgcgcctcggcctcggccagcagtacctggcgctcacgcagggacaccagggcattgacccgggggttgcagcgctcgatccggtccaggtaggccgacatcacttcgcgacaggaaaacctgcgggcgtggatcgcccgggacagctcgacggcgcccagctcaacaataggtccaaggtcttgtattgcgatatccatcaaggctacaccccgaaattcagtgtgctcggtttcttctctttgggtgcctcatgcaggcaataagtgcccagcagcgtcaacacgcaggcaaacaagacataaaacgccggagccaccggggtgcccagcaccttgctgagccaggtcacgatcagcggggcaaagccgccgaagaccatgaccgccacgttgtaggccaccgacaccccggtggaacgcacctgcaccgggaactgttcggccagcgccgtcggcgccgggccaaagaaaccgccgatggcgctgcacagcagcacctgcatcaccagcagccgctcgatcgagggcgccgcggcgacccagacgtacagcgggtacaccatgacgaaaaacgccagggtgaaggccagcaacaccgggcgccgccccagccggtccgacagcgcgccggacaatggaatcaccaccgtcatcagcgccaccgcgaacatctgcaccagcaacacctggtccagcggcaagccgaggttcttgtgggcgaaggtcggcatgttcaccagcaccacgtagaacgacaccgtcgccccgcaggccaggcccatggacaccaggatgctgcgccggtgctcgcgcagcacctgcatcaggcccgggccgttgccgcgcacctgcctgcgggcctcgacgaaggcttccggctcctccatgtacttgcggatccacaggcccaccgggccgatcagcaagccgatgacgaacggcaggcgccagccccacagatcgaggtcctcgggcgagaacagatgggtgaccagcgccaccatcgccgccccggagaacaccgccaggcattgcccgaccaattgccaggaaccgtacaggcccttgcggtgcgccggcgcgctttccaccaggaaggccgtggcgctggcgtattcgccgccggtggcgaagccctgcagcatgcgcgcgaccacgatcatcagcggcgcgcccatgccgatggccgcgtagttgggggcaaaggcgatcagggcgatggagactgtcatcaggcggatgatcagttgcatggccgccttgcggcctttgcggtcggaatacatgcccagcaggatgccgcccaccgggcgcatgaaaaagcccacgccaaaggtggccagggccatcagcagcgaggcgtactcgtcgtcggagggaaaaaactgccgggcgatgatgctggccaggaagccgtagacgatgaagtcgtaccactccagggcgttgccgatcaccgcggcgaccacttgccgggtacgcgaaacactggatttcgaggtgtgcatgagcgctgtccttctattcttgtcgggcctctcgggtaacgggtcggccccttatgggaagtgccgggcgccacggcgcccgattcagcggcagaagaaagggaaaactcaggccggctcgagccagctctcggccagcgcggcccaataggcggcgccggtcagcaggatgtcgtcgttgaagtcgtagccggggttgtgaaccatcggccgggacaggccgttaccgatgaacaggtagctgccggggcagcgctgcagcatccaggcgaagtcttcactgcccatcagcttgcgcgtgttgccgtcgaccgcctgctcgcccagcagcgccaccccgacctgacgggcgaattcggtctgctccgggctgttgaccagcaccggataggccgggcggtgttcgatgctggccgagcagccgaagctctgggcctgggtgtggatgatcgtcctgacccgttcgagcatctgctcgcgcactggtgcgttcagcgcccgcaggctcaggcgcagcaacgcctgttgcggaatcacgttggccgcctcgccggcctgcagcgcaccgaccgtcactaccgccgcctcctgggcatcgatgttgcgcgccaccacggtttgcaaggccatcaccacactggccgccgccaccagcggatcgaccgtcaggtgcggcatcgaaccgtgcccgcccacgccttcgagggtcacggtgagcaggtcctgggaggccatcatcggcccttgacgaaaacccaggtggccggccggcagacccggcatgttgtgcatgccgaacagcgcatcacaggggaaacgctccagcaggccgtcggcgagcatcgcttcggcgccgccctggccttcttcggccggctggaaaatcagggtcagggtgccgtcgaactggcgcgtggccgccaggtaacgcgccgcgccgaggagcatggcggtgtggccgtcgtgcccgcaggcatgcatgcatccgctgtggcggctgctataggccacgccgctgttctcgatgatcggcaaggcgtccatgtcggcgcgcaggccaagcctgcgcgggctgttgccattgcgcagcacagcgaccacgccggtcttgccgataccgctatgcacttggtagccccactcctccagggaacgggcgaccagcgccgaggtgcggttctcctcgaaaccgagttcggggtgggcgtggatgtcctggcgcacggcgcgcaggtcgctggcgacgtcgtcgagccaggcaaagatatgcgggaaacgggtcatgacgtatctcctcgggccgggtgtaatcccgttcttttttcggagcgtctcacggtgcggcaaggcgtgatcgcggcgtgccctcagataaccgcgagccgcctgccgcgacaatcaaatgtggttccacagggtggaaccttgtgcggggagccaatcagcatgggggctggcagcaccgggaaagggttaccgatctttacgcggcgccgttcagggctccagtcgacagccctggcgttcgcccagccagacagcactgtggctgcgtcccaggccgctggcgctgacccgcttgtgctcggcatcgtcctgcaggcttttcagtggcaggtattgctgcacataaccttcgcagtactcggcggcgttatgcatcacgtagcggcaggagcagtactccttggcgctgtaggcgctgaggatgtccgggaaggctcgcagggcgacccgctcgctccagccccagccgagcaaggccagcagcgccaacgacagcaggctgacgaagggatggcgcaggagccacggacgccggctcatggctgcacctgccgggcgaaggccgccagggccagcttgagcaatgcgttgtggctatagctgccgtcgcggtcgtcggcataacgcacgatcaccagcccggcgctgggaatcacgtacaacgcctgcccccaatggcccagtgccgcgaaggtatcggccggcgcatccggccagggcgacggggcgccgccaacggcgcggttgagccaccaatggccgccgggcaccagttcgtcctgattggcctgataaccggcgaacggcgtgcgattgaattcgacccagtccctgggcagcaactggcgctcgccccagcgcccgtcgcgcagcatcaacaggccgacccgcgccagatcgcgggcagtgaggtaggcataggaggaaccgacgaaggtgccggtggcgtcgctttcccacacggcgtgggtaatgcccaggggctcgaacagcgcctgccacgggtaatcggcataacgctgggcgcccagcatgcctttcagggccgccgacagcaggttgctgtcaccgctggaataacgaaacacctgccccggcgggctgaaagccgggtgctcggcggtaaagctcgccatatcgtcgtggccgcgggtgtagagcatggccaccaccgaggacttgaggggcgcgtactcgtaatcctcctgccagtccaggcccgaggcccagtgcagcaggtcggccaggctgatgtccgggtgctggcgcagcgccggcagaaagcgcgcggccttgtcctgcagctggaaacgcccttctccataggccacgcccagcaccgcggccaacaggcttttgctgatggaccaggtcaggtgcggggtatcggcgttggtcgggccggcataacgctcatagatcaactggccatcgcggatcaccagcaaggcgtcgctgcggatgcccaggcgggtcgcctcgttgcggggcgcgaaggcataggcctccaatgcctcaagggccgggccgctggctgcggggcccttgctccattgcgcgccgggccagttctcggcccaggcgggtgggagcatcaacagcaacgcaagcagcagggtcgagcctttgagcatggtgggaactcgggcaagggaacccgctgagggtagaccagggagatgacagtttttgtccggccggcggtcctgcggacctatcgcgagcaagctcgctcctacagaaaagcgaccctgcttatgtaggagcttgctcgcgatgggccgcacagcggtccctccttctatagagccagcgccttggccaggcgtttgctccgcgcccccgccgccaggtccagcaccgcccgatcgcgcttccacaattcggcccacagctccgggccatcggcaaaggcctgctcaagggccggcttgagcccgtcgaactgggcgaacaggccacccagcaacacatgcccgctgctcagcgaggggttctgccggctgacttccgcgcaaccggcgagcaaggccagcaattgcaggagcagggtctgcggccagtcgttgtcctggccgacgccatacagccaggcagtcatggcgctgagtacatagatgtcttccagggtgcggaagggtttgacgtaggcatcccaaccgtcgcccgccagccgttcgcacagggcgttatccagttgcaggcggccgtggctgatgtccggcatcagcgggatagccggcagcttgtcgaccttcaccccgggctcgccggcatggaccaccgccaggctcaggcgcggtgactcgccttgcgcttcgcagcgggcagcgatcagcagccagtcggcggcatcgccggcggtgacgaagtccttgcgcccgttcaggtgcaggtcccgcagccgggtctgcatgtcagccgggcgcaggctgcgctgctcggtggcgcacagcgcgcccaggctcagcggcgcgctgggccagagcatgcgcaaggccgcctggtagcccaccaggaaggccagccccggggtggccatcaaccgtccgccgcgcaccgccagctcgaagggcgtcaccgtgcccagctcctgtaacaacacggcataaccttcggccaggtccgggtgggcgggcagccggcgacggctgtgcaacagggcttgccagggcataagcgggtcctcaggggctgtcatataagcatcaccaaagcttcatggcgatgacaccggggctacatagcctgactttgcacaacaaagtcgatcggctgcaacccaaggcgggtcagtggcccgcacggagattcacaatgactcagatcgcccgcatcagcgacaccggcaatgaacgccgcctgcaagccgagcgcctggtgggcgccgcggccctgcaagaagcccaggccctgcgcttcaacgtcttcagcggcgagttcaacgccaaactgaaaggcgcggagctgggtctggacatggatgactatgatgtccactgcagccacatcggcgtacgtgacttgaacagcggccgcctggtcgccaccacccgcctgctcgaccaccaggccgccagcagcctggggcgtttctacagcgaagaagaattcagcctgcacggcctggtccagctcaagggcccgatcctcgagatcggccgcacctgcgtcgacccggcctaccgcaacggcggcaccatcgccgtgctctggggcgagctggccgaagtgctcaaccagggcggctacagctacctgatgggctgcgccagcatcccgatgcaggacggcggcgtgcaggcccacgcgatcatgcagcgcctgcgcgaacgctacctgtgcaccgagcacctgcgcgccgaaccgaagaacccgctgccgaacctcgatatcccgtccaacgtcatcgccgagatgccgccgctgctcaaggcctacatgcgcctgggcgcgaagatctgcggcgagccgtgctgggaccaggatttccaggtggccgacgtgttcatcctgctcaagcgcgatgagttgtgcccgcgctacgcccgtcacttcaaggcggccgtgtgatgcgccggctacgggtctacgggcgtatcgcccgggtgctgctggtggtggcgctgggcctgagcatggcctgcgtgttcggcgtgttcgagcgcctgggcgtcgcccattccatggtccggcgccagcgctggtcgcgctttttcatggcgcgcctgagcaatgccctgcccttcggcgtgacggtgcacggcgaggtgccgaagcagccgatgctgtgggtcagcaatcacgtgtcctggaccgatatcccgctgctcggcgcgctgacgccgctgtcgttcctgtccaaggctgaagtgcgcacctggccggtcgccggctggctggccgccaaggcgggcagcctgtttatccgccgcggttcgggcgacagccagttgatccgcaaacagatgacccgccatctgcagcagacccacccactgctgatgttccccgaaggcaccaccaccgacggccgcagcctgcgcaccttccacggtcgcctgctggccagcgccatcgacgccgacgtggcgttgcagccggtggccattcgttacctgcgcgatggtgatatcgatccgctggcgccgttcatcggcgacgacgacttgctgtcgcacctgatgcgtttgttcgccaacgatcaaggccgggtggaaatccatctgctgcagccgattgcctgccagggccaggaacgcgccgcgctggcgttccaggcgcaacaggcggtgcagaaggttctgtttggcgacatcgcccagccagccgagccacggcgtgccggcgacctgatcgcggcctgagccagggggagccggcgttccggctcctaccgcggctgcatatgttgcgcggcgaatgcctgcaactgcgggtagaacgcccggaaatcctcgctcaacggctgatacagccgctccagctcgcccatcgccgccgccagttcttccgggcgtgacaggcgccgggcaatcccccgcaacacctgctccagcacctcgaactcgcggtaggaacccagccagtcatgggcggccatatgcggcgcgatctgcgctaggcgcccgggcaaccggggttcggccgccagcacccgatatacgtccgaagtgaacaactccaacggccggtcggcatagagcgcccagtcccgggccaggcagtggtcgaaaaacacgtccaggacgatgccggcataacgccggcgggtcagggaaaaacgcgacagcgactcgcccaccaacggatggcggtcggtaaagatgtcgatgctgcgatgcagctggatcgccgcctcgatttccgggtcgaactggccctgcaggcgccctttgacgaagtcgccatacaaactgccgagtaattgaccggggcgctggccgccgagatgcagatgtgcgagataattcattcgcgcagcttagcaccgcgcctcatatatcgttataacccgatataccgattaacgctgatctcagatcaaaatcatattggtatatcgcgaaatagcgatttaaagttcgcctcatcgcgatataacgttttacggaaaacgagcaccgccatgtccatcgacctcgacgaaataataaaagccctggcgcacccagtacgacgagacatccttatctggctcaaggacccgaaggtccagttccccgatcagacccacaaccatgagtacggcatctgcgccggacagatcgaccaacgctgcggcctgtcgcagtcgaccgtctccgcgcacctggcgaccttgcaacgggccggcctgatcagcagccagaaagccggccaatggcactttttcaaacgcaacgaagatgtgatccaggccttcctcgagaagctgaccgcagaacttcgcatcaaagactgacaaggacccgacaatgcccctctcgctcctcatcctggccttgagcgccttcgccatcggcaccaccgagttcgtcatcatgggcctgctgcccgatgtggcgaacgacctgggtgtgtcgatccccggcgccggctggctggtgaccggctacgccctgggcgtggcgatcggcgcgccgttcatggccctggccgccgccaggctgccgcgcaaggccgccctggtggcgttgatggggattttcatcgtcggcaacctgctgtgtgcgctggccagtgactatgacgtgctgatgttcgcccgtgtggtcaccgccctgtgccatggcgccttctttggtatcggttcggtggtcgcggcaggcctggtgcccgccaacaagcgtgcttccgccgtggccctgatgttcaccggcctgaccctggccaacgtgctcggcgtaccgctgggcacagccctgggccagcaggccggctggcgttcgaccttctgggcggtgaccgtgatcggcgtgattgccctgatcggcctgatccgcttcctgcccgccaagcgcgacgaagagaagctcgacatgcgttcggaactgatcgccctcaagggcgccgggatctggctgtcgctgagcatgaccgcgctgttctccgcctcggtgttcaccctgttcacctatgtcgccccgctgctgggcgaggtgaccggcgtctcaccccagggcgtaacctggaccctggtgctgatcggcctgggcctgaccctgggcaacatcgtcggcggcaagatggccgacaagagcctgtcgggcaccctggtcggcgtgctgatcgccatggccgtgaccagctccgtgctgacctggaccagcgtcgcgctgatccccaccgaagtcaccctgttcctctgggccaccgcctgcttcgccgcggtgcccgccctgcaggtcaacgtggtgaccttcggcaaggccgcgccgaacctggtgtccacgctgaacatcggcgccttcaacatcggcaacgccctgggcgcctgggtcggcggcagcgtcattgcccacggctacggcctggtcaacgtgccgctggcggccgccgcgctggcggtcctggccctgctggtgacgctgattacctttcgccagggcggcaacgccgatctggctcctgccaccaactgatacgttcatctaaagaagggtgtatttcatgacgactattttcgatccgatcaaactcggcgacctcgagctggccaaccgcatcatcatggcgccgctgacccgctgccgcgccgacgagggccgcgtgccgaacgcgctgatggccgagtactacgtacaacgcgcctccgccggcctgatcctcagcgaggccacctcggtgaccccgatgggcgtcggctacccggacaccccgggcatctggtccaacgaccaggtgcgcggctggagcaacgtgaccaaggccgttcacggcgcgggcggcaagatcttcctgcagctgtggcacgtgggccgggtttcacacccgagctacctgaacggcgaagcgccggtcgcgcccagcgccatccagcccaagggccacgtcagcctagtgcgtccgctggccgactacccgaccccgcgcgccctggaaaccgctgaaatcgcagatatcgtcgacgcctaccgggtcggcgccgagaacgccaaggccgctggttttgacggtgtggaaatccacggcgccaacggctacctgctggatcagttcctgcaaagctccaccaaccagcgcaccgaccagtacggcggctccctggaaaaccgcgcccgcctgctgctggaagtgaccgacgccgccatcgaagtctggggcgccggccgtgtcggcgtacacctggcgccacgggccgactcccatgacatgggcgacgacaatctggccgaaaccttcacctatgtcgctcgcgagctgggcaaacgcggtatcgcctttatctgctcgcgcgagaaagaaggcgccgacagcctcggcccacaactcaaagaagccttcggcggcccctacatcgccaacgaacgcttcaccaaggacagcgccaatgcctggctggccagcggcaaggccgatgccgtggccttcggtgtgcccttcatcgccaacccggacctgccggcccgcctgaaggccgatgcaccgctgaacgacgcgcgtcccgagctgttctacgccaagggcccggtcggctatatcgactacccgacactgtaagacgcttcaataaaaagccccggactcgcaagagccggggctttttactgcgtcacgcaaacatgcctccataggagcaaggggatgcctgccaaggtgacacaggcgccaggcaatcaaccgcgtttgcgctggccccaggccacggccaggccgctgaggcagatcaccgcgatcccgactatgccgaagctgtccggggtgtgatcgaagatcaggtagccgtacataccggcgaacaggatctgcccgtagctgaatggcgccagcatcgccggcgcggcatggcggaaagcctgggtcagcaacaggtggccgagcatgccgcaggtaccgaggccgatcatgaacagggcgtgccctagggtcggcgtgctccagaagaacggcagcgccgcgctcatgatcaggctgttgagaatcccggtgaggaagttgctggtggtggggctgtcgaccccgctgagcttgcgggtgagcaactggtagaagccgaaacacaaggccgagcacagcggcagcaggatcgccggggtgaacaaggcaccgcccggacgaatcacgatcaataccccgacgaaaccggccagcaccgccagccactggctgcgggtcacccgctcgcccagcagcggcacggacaaggcggtaaccagcaaaggcgcgaggaagttaaccgcggtggcctcggccagggggatataacgcaggccggtggtgaaaaacaggctggtgccgatcaggcacaaggcgcgcaacagttgcaggcccgggcgcttggtacgcaccacggcggagaaaccgctgcgtggcacgaacaccaccagcatcaacagcgtgtgcaccacataccgggcccagaccaccatgacgatgggatagaacccggacaggtatttggacagggtgtcatgactggcgaacagcaaaaccgccaggcaaatcagtgctatacctttgaccggttgctcggtgcccttataagccgcggtactcacactcattcacatactcgcaacaatttccctacaaaatacgtagctcgctatctatcaagataaagtcggcacgtatataaagcatcccggtgagccgtgacgaataaaacatcgcgttttataacgcgcaaacgttgacatctgccgacgtaattccgcattttgtctcaattacgcaggctgggactcaggcgcagcatgtccaatccggtatcgatccagcgctccgcttccttatggagttcgaaactgtccggcgccaacagccactgataaagaatgccatcaatataggcgtggatactgatggccgcccgggcagtatcgaggttctcgggcagttgtccccgcttcacggcattgcgcaacgccagctcgatatgcacgttgcaatccaggctggccgcgcgacgctggcgccgcaagtcgcacatttcatcggtgaattcgcacttgtgaaacaaaatctcattaatgcgtcgggttttcgggtccagggcaatttgatgaaacaaatgaatcagcagcttgcgcatgcaccccagcggatcgacttcctcttcgtcttcactggccctggccatttcattcagcggctcgcgcaaggtatcgagcatggcctgcaccagatccgccttgttgctgaaatgccagtaaatagctccacgcgtgacaccggccaaagtcgcgatatcggccagggtggtacgcgccacaccgcgctcgtagaaggctttttcggccgcctcgagtatctgtttgcgggtttcttgagcttcctctttggtacgacggaccatggcagtaaacctcgatcaggatgtttcagcgatgcatgaagctcatctgaataaatatggaacggcatctcgggtgccgtttgcccaacctacaattcgacacttgcaacggcttttgtaaccgaatgggtacgccgccaaggtatttacaaacaaccatgaacgtaagtatattccttagcaagctacttatccactcagcactcgttttttacccttccacttttcgagtgcgcattttgcgcgcctgacccgaggatcttcatgcaactcaagccagctgttaccgctctggtcactgccgtcgccctggcatcgctgctcagcggatgtaaaaaggaagaggcggctcccgccccacaagcccctcaggtcggcgtagtcaccctgcaacctcaagcctttaccctgacgtccgagcttccaggacgcaccactgcgttccggatcgccgaagtccgtcctcaggtcaacggcatcattctcaagcgtctgttcaaggaaggcggcgacgtcaaggaaggtcagcagctctatcagatcgatccgtcggtctatgagtcgaccctcaagagcgcccaggccaacctgcaatcgaccaagtcgatctccgatcgctacaagcagttggtcgacgagcaagccgtaagccgccaggaatacgacaccgccgtcgccaaccgcctgcaatcggaagctgcgctgcagagcgcccagatcgacctgcgctacaccaaggtgctgtcgccgatctccgggcgtatcggccgttcttcggtcaccgaaggcgcattggtcagcaacggtcagtccaccgccatggcgaccatccagcaactcgacccgatctacgtcgacgtcactcagtcgtcggtggaactgctcgagctgcgtcgcgagctggaaagcggtcgcctgcagaaggccggcgacaacgccgccaaggtcaagctgaccctggaagacggcagccagtacaagctcgacggcaagctggagttctccgaagtgtcggtcgacgaaaccaccggttccgtgaccctgcgcgcggtgttcccgaacccggaacacaccctgctgcccggcatgttcgtgcacgcgcaactgcaggccggcgtgaatgccgcggcgatcctcgccccgcaacaaggcgtgacccgcgacctcaagggcacaccgaccgccctggtggttggtccggacaacaaggttgaactgcgtcagctcaaggccagccgcaccgtcggcaaccagtggctgatcgaggacggcctgaaggccggtgatcgcctgatcaccgaagggctgcaattcgtccgacctggcgtcgaagtcaaagccagcgaagcgaccaacgttccagcaaaaaacccggccactgcacaggcgactgacaaagctgcaggcggcaaaggggagtaaaccatgtcgaaattttttatcgaccgtccgattttcgcctgggtaatcgccctggtgatcatgctggtcggggctctatcgatcctcaaattaccgatcaaccaatacccgagcatcgcgcctccagcgatcgccatctccgtgacctacccaggcgcttccgcacagaccgtgcaggacaccgtggtccaggtcatcgagcagcagctcaacggtatcgacaacctgcgttatgtgtcctcggaaagtaactccgacggcagcatgaccattaccgcgaccttcgagcagggcaccaactcggacaccgcgcaggtccaggtacagaacaagctgaacctggccaccccgctgctgccacaagaagtgcagcaacagggtatccgcgtaaccaaggcggtgaagaacttcctgttggtgatcggtgtggtttccgaggacggcagcatgtccaaggacgacctctcgaactacatcgtgtccaacatgcaggacccgatctcgcggaccgcgggcgtgggtgacttccaggtgttcggtgcccagtacgccatgcgtatctggctcgacccggccaagctgaacaacttcaacctgactccggtcgacgtgaaaaacgccgtggcggcgcagaacgtccaggtgtcgtccggccagatcggtggcttgccagccctgccaggccagcaactgaacgccaccatcatcggcaagacccgcctgcagactgccgagcagttcaaggccatcctgctgaaggtcaacgcggacggctcgcaagtgcgtctgggcgatgtcgcggatgtggctctggggggtgaaaactactccgtcagtgcccagttcaacggtgccccggcttccggcctggccgtgaaactggccaacggcgccaacgccctggacaccgccaaggccctgcgcaagaccatcagcgacctggaaccgttcttcccgcaagggatgaaagtggtgttcccgtacgacaccaccccggtggtgaccgagtcgatcaagggtgtggttgaaaccctggtcgaagcgatcgtgctggtgttcctggtgatgttcctgttcctgcagaacttccgtgccaccgtcatcaccaccatgaccgttccggtggtgttgctgggtaccttcggtatcctcgcggccgccggcttcagcatcaacaccctgaccatgttcggcatggtgctggccatcggcttgctggtggacgacgccatcgtcgtggtggaaaacgtcgagcgggtaatggccgaggaaggcctgtcgcccaaggaagcgaccaagaagtccatgggccagatccagggcgccctggtcggtattgccctggtgctgtcggcggtactgctgccaatggcgttcttcagcggttccaccggtgtgatctacaagcagttctcgatcaccgtggtctcggccatggcgttgtcggtcctggttgccctgatcttcactccggccctctgcgccaccatgctcaaggccattccccatggcgagcacggcgcgccgaaaaaaggtttcttcggctggttcaaccgtaacttcgaccgcagcgtcaaaagctacgagcgtggcgtgggcaacatcctgcggcacaaggcgccttacctgctgacctacgtgctgatcgtggtcggcatgatctggctgttcatgcgcatcccgtccgcgttccttccggaagaagaccagggcgtactgttcgcccaggtacagaccccggccggctccagttccgagcggacccaggtggtagtcgatgaaatgcgcgcctacctgctggacaaggaaaaggacaccgtggcctcggtcttcaccgtgaacggcttcaacttcgccggtcgtggccagagttcgggcatggcgttcatcatgctcaagccgtgggacgaacgctccgtggaaaacagcgtgttcaacctggcggcccgggcccagcagcacttcttcagcttccgcgatgcgatggtgttcgccttcgccccgccggcggtactggagctgggtaacgccaccggtttcgacgtgttcctgcaggaccgcgccggtatcggccacgaaaaactgatggaagcgcgcaaccagttcctcggcatggcggcgcaaagcaagatcctgtcccaggtgcgtccgaatggcctgaacgacgagccgcagtaccagctggaaatcgatgacgagaaggccagcgccctgggcgtgaccatctccgacatcaacaacaccttgtcgattgccctgggcagtagctacgtcaacgacttcatcgaccgcggtcgggtgaagaaggtgtacatccagggtaagcctaacgctcgcatgagccccgaggacctgaagaagtggtacgtgcgcaacagcgccgggaccatggtaccgttcgcctccttcgccaagggcacgtggatctacggttcgccgaaactggctcgttacaacggcgtggaagcggtggaagtcctgggtgccccggcgccgggctacagtaccggtgaagccatggccgaagtcgaagccatcgccaagaagcttccggccggtgtcggtatctcctggaccgggctgtcctacgaggaacgcctgtcgggctcgcaagctcccgcgctgtacgccttgtcgctgctgatggtgttcctgtgcctggcggcgctgtatgaaagctggtcgattccgatcgcggtcatgctggtggtgccgctggggatcatcggtgcgctgatggcgaccagcctgcgcggcctgtccaacgacgtgtacttccaggtggggctgttggtaaccatcggcctggcggcgaaaaacgcgattctgatcgtcgagttcgccaaggaactgcacgagcagggtcgcagcctggtggacgcggcgatcgaagcctgccgcatgcgtctgcgtccgatcatcatgacctccctggccttcgtgctcggtgtggtaccgctggccatctccaccggcgcaggctcgggtagccagcatgcgatcggtaccggggtgattggcggtatgctcaccgcgactgtcctggcgatattctgggtgcctttgttcttcgtcaccgtgtccaagatgggccgtcgcaaggcagacgaagcgcaaactactgaaactcctgaagaggctggccaatgagcaagtcgctactctccctcgcaatcaccgccgccgtgctgagtggttgctcgctgataccagattatcagcaaccgcaagcgccggtcgcggcgcaatacccgcaagggccggcctattcgcctgcggaggctgccaaccaggcagccgccgaacagggctggcggcagttcttccatgaccctgccctgcagcagctgatccagaccgcgctggtgaacaaccgcgacctgcgggtcgcggcgctgaacatcgacgcctacgccgctcagtaccagatccagcgcgcggacctgttcccggcggtttcggccaacggcagcggcagccgtcaacgcaccccggcacggttgtcgcagaccggtgaagcggccatctccagccagtactcggcaaccctgggtgtcagcgcttatgagctggacctgttcggtcgcgttcgcagcttgagcgagcaggccttgcagacctacttctccagcgaagaagcccggcgcagcacgcagatcagcctggtggccagcgtggccaatgcctacctgacctggcaggccgacaaggaactgctcaagctgacccaggacaccctggcggcctacgaggagagctaccgcctcacctcgcgcagcaacgaagtcggcgtggcctcggccctggacctgagccaggcgcggacctcggtggaaaacgcccgggtgcaactggcgcgttatacccgccaggtggcccaggacgaaaacagcctgaccctgctgctgggtacctcgatcccggccaacctgccgagcccacagccgttgtcggccgacctgctcagcgagttgcccgccggcctgccgtcggaactgctgcaacgccgtccggacatcctcgccgccgagcacaacctgaaagccgccaacgccagtattggcgcggcacgcgcggcgttcttcccgagcatcagcctgaccgccaatgccgggaccttgagcccggatatgggcggcctgttcaagggcggctcgggcacctggtcgttcgcgccgcagatcaatatcccgatcttcaacgccggcagcctgcgcgccagcctggattactcgaaaatccagaaagacatcaacgtcgcgcagtacgagaagtccatccagaccgccttccaggaagtctccgatggcctggccgcacgccagacctacaaccagcagttgcaggcccagcgtgacttcgtcaacgccaaccaggactactaccgcctggccgagcgtcgctaccgcatcggtgtcgacagcaacctgaccttcctcgacgcccagcgctcgctgttcagcgcgcagcaagcgttgatcaccgaccggcttgcgcagctgaccagcgaggtcaacctgtacaaggccctgggcggcggttggaacgagcaaggttcgcagaaagtggaagtgagcaaagaggcaccgccactgaagctgttctgagtgcatgccgcttgaaaaaaacccaccttgcagtgggtttttttatgggccgaagaccgccgtcacttgtgttcgttaatcgcccaaaacccgccaaggccaattgaacagggtcgttgatccaacgcaccattccccgcacctgcaaaaaccaataacaacaggttcgtcatcatgaccccgcgccctgcccgctccggctgattccgttccctccaccctcccggtttcaaccttgtctgcaacctgacgttgccgcagcgcccagcctcacccctaacaattagagatcccgatccatgaagccatccactcgcactccctattcactgctgcccagcctgctagccgtcggcatcgccggcacggccctgccggtcatggccgcggagtccggctttctcgaagacgccaaggtcaacctgaacctgcgcaacttctacatcaaccgcaacttcaccaacccgggcaaggcccagggcaaggctgaagaatggacgcagagcttcatcctcgacgccaaatccggcttcacccaaggcaccgtcgggttcggcatggacgtgctggggctgtactcgttgaagctcgatggcggcaaaggcaccggcggtacccagttattgccgctggatcacgacgggcgcccggccgaccacttcggtcgcacgggcgtggcattcaaggcccgcctgtcgcagaccgaggtcaagctcggcgaatggatgccggtgctgccgatcctgcgctcggacgacggtcgctccctgccccagaccttccgcggcggccagatcacctcgaaggaaattgatggcctgaccctctacggcggccagttccgcgccaacagcccgcgtgacgacagcagcatgagcgacatgtcgatgaccggcaaagcggccttcacctccgaccgcttcaacttccagggcggcgaatacagcttcaacgacaagcgcacccaggtcggggtgtggaacgcccagctcaaggacatctacagccagcaatacctcaacctgatccacagccagccgctgggcgactggaccctgggcgccaacatcggcttcttctacggcaaggaagatggcagcgcccgcgccggcgacctggacaacaagacctggtcgggcctgttctcggccaagtacggtggccacactttctacgtcggcctgcagaaactcaccggcgacagcgcctggatgcgcgtcaacggcaccagcggcggcaccctggccaacgacagctacaacgccagctacgacaacgcccaggaaagatcctggcagctgcgccatgactacaacttcgtcgcggttggcatccccggcctgaccctgatgaaccgctacatcaagggcgacaacgtgcataccggcaccatcaccgacggcaaggaatggggacgcgagagcgaactggcctacaccgtgcaaagcggcacgctcaagaacctcaacgtcaaatggcgcaactcgaccatgcgccgcgacttcagcaccaacgagttcgacgagaaccgcctgatcatcagctacccgatcagcctgctgtaagcccactcgctcgcccacaccaaaaacaaggccagccccattccccggggctggccttgtttttgtaggagcgaagcttgctcgcgatgatcgtcaacgatggcgcgtactgacgggctgaacgcggcgctctcaggctcatcgcaagcacgctcgctccgacagggaaaacgcagcggcgccgagttgctcggcgccgcgtttctttacaagtcgtgggttatcaggcacgggattcgacgcccagctcgtcccacaccgactcggccaggtggaaggtcgcgttggccgccggaatgccgcagtagatcgcgctctgcatgatcacttccttgatctcggcgcggctcacgccattgttggcggcggcacgcaggtgcagcttgagctcttcgttgcggttcatgccgatcagcatggcgatggtgatcaggctgcgggtatgacgcggcaggcccggacgcgtccagatatcgccccaggcgtgccgggtgatcatttcctggaactccgagttgaactcggtcagggtactcaggctgcgatcgacatgggcatcgcccagcaccgcgcgacgcacttgcatgccttcggcgtaacgttgtttctcgtccacggggggctccttaaatacgctggtcggccagcaaaaatgccacgacccgctcgctaaacgcagcgccagcctggacgttggacaggtgcgccgcatggaactcggcgtattcggcgccgcgcacgcgctcctggatgaagtgcccccccgcgggcggcgtgaccgcatcttcggtaccggacaccaccagggtcggcgcctcgatcgccgacaattgatcgcggaagtccgcatcgcgcaccgccgcgcagttggcggcatagccctggggcgaggtggccgccagcatgtcggtgatcagcttggcctggtccgggtgcgccgcggcgaagtccggggtgaaccagcgggcgatcgaggcgtcgcgcaatgcgaccatggctgcctggccgtcacgcagcacggtttcgatccgtgggttccataccgacgggtcgccgatcttcgccgcggtgttgcataccaccaacttgttcaggcgctcgccggcattgatacccagccactggccgatcaacccgcccatggacaggccgcagaaatgcgcacgctggatatgcagcgcgtccagtagcgccagcacatcgtgccccaattgctcgatgctgtaggggccttcggtgaccagggatttgccgtggccgcgagtgtcgaaacgcagcacccggaagtgcttggtaaagaccggaatctgcatgtcccacatgtgcaggtcggtacccagggagttggacaggaccagcaccggcgcatcggccgggccgtccagttggtaatgcagttcgccatcggcgagttgtacgaatgccacggcagtctccttcaggcgttcaaggctaaatgttcggccacggcgcgctcgacccaggcgtgcgcctggccgaggtaatgcgccgggtccagcaggcgatccagttccgtcgccgacagctcggcggtcacttgcggctcatcccccagcaccgcgcgcagatgccgctgttcggccaccgcgcgcttgcagcattgctccagcagatggtgcgcggtctcgcggcccaggcgctgggccagggcgatactcacggcctccgccagcaccagcccctgggtcaggtcgaggttcctggccatgcgcgcggcgtcgacttccagcccgtcggccaccagcagcgcctgttgcaaggcgccggacaccaggcagcaaatctccggcagggtttcccattcggcgtgccacaggcccaggctgcgttcgtgctcctggggcatggcgctgaacatcgtcgccagcagcccgggaacccgggtcgccgcgccgatcaacaccgccgcgcccaccgggttacgcttgtgcggcatggtcgaggaaccgcccttgcccggcgccgacggctcgaagacttccgccgcctcggtctgcatcagcaggctgatgtcacggccgagcttgccgaggctgccggcgatcaggccgagcaccgaagcgaactccaccaaccggtcgcgctgggtgtgccagggttgttccggcaggctcagttgcaactcctcggccagggcctgggcaatcggcagggcctgctcgcccagggccgcgagggtcccggaggcaccgccgaactgcagcaccagcaagcgcggcttgagctgcgccaggcgctcgcgactgcgggtcactgcccccagccagccagcgatcttcatgccgagggtgaccggcgtggcatgttgcagccaggtgcggccggccatgggcgtgtcggcataacgctgggcctgggcggccaggatgccgccgaggcgcgccaggtcgttgtcgatcaagctcagcgcctgccgcagttgcaggaccagcccgctgtccatcacatcctggctggtggcgcccaggtgcacataacgctcggcgctggcatcgctcttggcgatctgtttgcccagggccttgaccagcggaattgccgagttgcccgccgtggcgatggcctggcccagggcggcaaaatcatagagcccggcccggcaggccgcctcgatcggcgccaccgctgcggccgggatcaccccgacccgggcctcggcccgggccagcgcggcctcgaagtcgagcatggcctggacccgcccctggtcgcagaacaccgcgcgcatatcgcgggtggtgaagtaggcatcgaacagttggttgctcgccggtgtgctcataaacaatcctttggggcgtgcgtccgcgacggacgcacgcggacaggtcacagatcgtggtgcaggtacgccgcctgtttcggcaggcgcaggctgaacaggaaggcaatcgccatcatcgccgtcacgtaccagtagaaggtgttttccatgcccagggatttcaggcccagggccacgtattccgccgaaccgccgaacagcgcgttggccaccgcataggccaggccgacccccagcgcccgcacttgcggcgggaacatctcggcttttaccaggccgctgatggaggtgtagaaactgacgatcgccagggccagggtgatcagcacaaaggccaggaacgggctggtaacggttttcagggtcagcaggataggcacggtgcacagcgtgcccagcgcgccgaaccagagcatcgagttacgccggccgatcttgtccgccaacatgccgaacagcggctgcatgcacatgtacaggaacagcgcgccggtcatgatgtagctggcggtcttggcgtgcatgccggcggtgttcaccaggtatttctgcatataggtggtgaaggtgtagaaaatcagcgagccgccggcggtgtagcccagcaccgtgacaaaggccttcgagtgatgcttgaacagcgcggccacgctgccggcgtccttgtcttcacgcatttccttgctggtagtttctttcagcgagcgccgcagcagcagggagatcagggcggcaatggcgccgatcacgaacggaatccgccagccccaggccttgagctccgcctcgtcgaggaactgttgcaggatcaccaccaccagcaccgccagcagttgcccgccgatcagggtcacgtactggaaggacgcgaagaacccgcgctggcccttgagcgcgacttcgctcatgtaggtcgcggtggtgccatattcaccgcccaccgacaggccctggaacagccgcgccatcaacagcagcgccggcgcccaggcgccgatgctggcgtaggtcggcaggaaggcgatgaccaaggagccggcgcacatcatcagcaccgagatcatcatggaattcttgcgcccgtgcttgtcggccacccggccgaacagccagccgccgataggacgcatcaggaacccggcggcgaacacgccggcggtattgagcagttgcaccgtggggtcgtcggaggggaaaaacgccggggcgaaatagatcgcgcagaaggcgtagacgtagaagtcgaaccattcgaccaggttgccggaggaagcgccgacgatcgcgaagatcctcttgctgcgctcctcggtcgtgtagtgactggttaacgttgtcatggcttttcactctttggggacgtggtgagtctagacatactttgtaacagtcccgttccgcaagacgaccttggaggtgtcggcctattcggccttatcgcgagcaagctcgctcctacaggatatgggtcggtcacgatgccgtgattcaactgcggtcatgtaggagcgagcttgctcgcgatccccccaggcacactcaataatcgaagaacaccgtttccgcgtcggtcccctgcaggatcacgttccactggtagtggcccgcggcatccgccttggccagcaaggtggcgcgacgctcttcgggcacgcaggccagcagcggatcggcggcgttggccggttcgccgtcgaagtagatacgggtcagcaggtgcttgaccaggccccgggcaaacaccagtaccaccaggtgcggcgcctgggtcgagcctttcaggccaggtacggtgcccggcttgatggtggtgaagcggaaacgcccttccccatccaccggcacccggccgaagccctggaagttcgggtccagggccttggcctgatcgtcttccgggtggtcgtacttgccgaccgcgttggcctgccagatttccagcatggcgtcgttgacgaaatcgccgttgccatccaccacctggccgctgatcgccacccgctcgccgagggtctcggcctgggtcaggtcttcgcggttcagccaggtcaggccgatgtggtagtaggggccgacggtgtgggacgtggtcgcagtcagcgtcatcttatttctccatcggcgtggcatcgcggccgcgcaagacgatgtcccaacggtagccgagggcgtaggacggaatggttttctccaggtcgaagttggcgatcaggcgttccttggcgctagtgtccggcacgcagttgtagatcgggtcgtaggccagcagcgggtcgcccgggaaatacatctgggtcaccaggcgcgtgagaatactcgggccgaacagcgagaagtggatatgcgccggacgccaggcattgtggtggttaccccaggggtaggcacctggcttgatggtctggaactggtaccagccatcggcatcggtgacggtgcgcccggtaccggtgaagttcgggtccagcggtgcgtcgtgcaggtcgcggtcgtggttgtagcgaccggcggcgttggcctgccagatctccaccaggatccccggcaccggcaggccgttctcgtccagcacccggccgtggatgatgatgcgctcgccctggggctcgccggcatgctgggcggtcaggtcgttgtccttgtcctgcaggtaatcggcgccgatggtcgggccggtgatttccgacagcgaatggggcaggaacaccagcggcttggacggcgagcgggtgttggtggatttgtaggccgggtgcaggtaatcaggctgagtacctggttgcgggcgccggtaaccgggcttgtcggtcatgctcgttcctcgttcttataagaagcgcgtcagacgcgctcgatggccaatgccaggccctggccgacacccacgcacatggtcgccaggccttttttgccaccggtcttttccagctggtgcagcgcggtcaataccaggcgcgcaccgctcatgcccagcggatggccgagggcgatggcgccgccgttggggttgacctgtggcgcgtcgtccgccaggcccagttcgcgcaatactgccaggccctggctggcgaaggcttcgttgagttcgatcacatcgaaatcgctgactgccacgcccaggcgttcggtcaacttgcgcaccgccggcaccgggccgatgcccatcacccgtggcgccacgccggcgctggccatgcccagcacccgggcacgggcggtcaggccgtgccttttcaccgcctcggccgacgccaggatcagcgccgccgccccgtcgttgacgcccgaggcgttgccggcggtgacggtcttgtccgggccgttgaccggcttgagcttgcccagggtttccagcgaggtatcggcccgcggatgctcatcctgctcgaccacggtctcgcccttcttgtggacgatacgcaccgggacgatttcctcggcgaagaacccggcggcctgcgccgcggcggtgcgctgctggctgcgcagggcgaacgcatcctggtcggcacgcgacacctgataatcgtcggcgacgttgtcggcggtctgcggcatcgcatccacgccgtactgggccttcatcagcgggttgatgaaacgccagccgatggtggtgtcttccagcttcatgttgcgcgaaaaagcggtatcggccttgcccatgacaaagggcgcgcgggacatcgactcgacaccgccggcgatggccagctccatctcgccactggcgatggcgcggaaggcggtgccgatggcatccatgcccgaagcgcacaggcggttgagggtcacgcccggaatggtttccggcagcccggccagcagcagcgccatgcgcgccacgttgcgattgtcttcgccggcctggttggcgcaaccgaggaacacctcgtccaccgcgctccagtccaccgacgggttgcgctcgatcagtgccttgatcggcgcggcggccagatcgtcggcccgcaccgtcgacaggccgccaccaaagcggccgatgggggtacgaatggcgtcacagataaacacttcgcgcatcaggcttctcccggggtttggccatgggccgcggcggtgcgggcttccaggtcacgcagggcggtcaattcgatctcggtcggggcggcggtttccgccacctggtcggcgaaacggatcgcccagccggtggcagcgaccacctgctcgcgggtcacgcccgggtgcagcgaggtcaccacgaattcatgggtgccggcttccggctccatgatgcacaggtcggtgatgatccccaccggcccggcccctggcaggcccaggcgtttgcgcgagtcgccgccttcgccgtgaccgaccgaggtgatgaagtcgagcttgtcgacaaaggaacgcgacgactgcttgaggatgatcagcacgctcttggccgagccggcgatctccggcgcaccgccggcgcccggcaggcggactttcggctggtggtaatcgcctaccacagtggtgttgatgttgccgaatcggtcgacctgggcggcgccgaggaaaccgacgtcgatccgcccgccttgcagccagtagcggaagatctcgccggtcggcaccacggtgtccgcggtctcagccagctcgccgtcaccgatggacagcggcagcacgctgggcttggcgccgatcgggccggattcgtagatcagcaccacgtccggcgacgaggtcaggcgcgccaggttggcggccttggacggcaggccgatcccgacaaaacacaccgagccgttctgcaggcggcgggcggcggcaacggtcatcatttcattggtggagtaagtcattatttggcccccgttgctgcggccagcttggcctggaattcgctgaagtcagcactgccgcggatgtattcgttgatccaggcggtgaaggtttcacggtcgcgggcgatcgggtcccaggcctggtagaagatgttgtcgcgctcggtgtacccgtgggcgtaggacggatgggcgccgcccggcacatggcagaccgcgctcagggcccaggtcggcagcacgcaggcgttcatcggggcgttcaggtcgtcgacgatttcttccacagtgacgatgcagcgcttggcggccagggcggcttccttctgtacgccaagaatgccccacaacagcacgttgcccttgcggtcggctttctgcgcatggatcacggtgacgtcaggacgtaccgatggcaccgccgccagcacttcaccggtgaatgggcaggtcacgctcttgatcagcgggttgaccttcggcaggtcggaaccggcataagcgcgcaagaccgcgaatggcaggcccgaggcgcccgccacgtaggcgttggccaggtcggcgtggctgtgttcttcgatttccagggggtgcggccattgcttctcgaccgcgtcccgcaggcgatgcagggagccgacgcccgggttgccgccccaggagaaaatcagcttgcgggcacaaccggcaccgatcaactggtcgtagatcaggtcaggggtcatccgtaccagggtcaggtcttttttgccctggcgaatgatttcatgacccgcggccgtggggatcaggtgggtgaagccttcgagcgcgacggtatcgccgtcgttgacgaactgcttcaccgcgtcgtgcagcgaaaggatttcagccatgggggatctcccgattgttattgagcgactggaagaaaaaggcgccgaaggatgcgccggagtgactgaagattaagccgagggaaaaagccaaacaatccgataatcgactgagcgttcgtttatcgaacagattgttgtctgactatcgattgtgttgtggccgctgccgcaggctgcgatcgacccgggccgcgttcggagaacggtcgcgaagatctcaggacgctgaaggccttcggccttatcgcagcctgcggcagcggctacaggtattcagcgcccccttcgggagcgccttgctcattcgctcaggtcgcgtccgcatggctgaccatgcccttgatcaccaccgccgtggtcgccagcgcggctgggatcaccagcgcggtcagcacttgctcgaagttccagcccagccccagcagcgtggcgcccatccaggcgccgaggatcgccccgaagcgaccgatgccgagcatccacgacacgccggtggcgcggccctgggtcggatagaagcgcgcggccagggatggcatcgccgattgcgcgccgttgacgcacatgccggcgaccagcaccagggtcgccagcaaggtgatgttacccaggctttgcccgaccgcgtaggcgaagatcccggccagcaggtagaaggtgccgatgaccttgtgcgggttgaagcggtccatggcccagcccaccgccaccgcgctgagtaccccgccgaactggaacagcgcgccgataaaggccgcctgctccatgcttgcgccgctgtcgcgcatcagggtcggcagccagctggtcagcaggtacacgatcaccagccccatgaaataggtcagccacaacagcaaggtaccgacgctgtaggtcccggagaaaatcaccgcaaacacgttgcgcgctttcacggtcttctgctccggcacgctgaagctcgcggcctggccgaccgtgcccggctcgatcggcgccagggccttgcgcaccttgtcggtgccacgattgcgcaccaccaggtaacgcgccgactccggcagccagaccagcagcaccagtgccaggatcaacggcaaaatcccgccgatcagcaacaggctgtgccagccgaacgccgggatcagcttggcggaaatgaaaccgccgccggccatgcccaggttgaaaccacagaacatgctggtcaccagcaacgacttgtggcgctcgggggtgtattcggaaagcagcgtggtggcattcggcatgccggcgcccaggcccaggccggtcaggaaacgcagcaccagcaactggtcgacattgctgctgtaggccgacgccaggctgaaggcaccgaacagcagcaccgcccccaccagcaccactttgcgcccgaagcggtcagccagcgggccggagcccagcgccccgaagaccatgccgatcagcgcggcactcatcaccgggccgaggctggcgcggtcgatgccccaatcctgggacagcgccggcgcgataaagcccatggccgcggtatcgaggccatcgaggaagacaatcaggaaacacaggatcaccacccgccactgatagcgcgacagcggctgggcattgataaaggactgcacatcgaggcagttccctacagcggattgaggctggttcattatttttattccacgcgaaaaacgcaggcgcacaggtgccagccagagctggtcggttcagatcgaaagggtcttgcgggatcaggccgtcggcaggcgaaggcaggatagaggggcgcggctgggcgcgcgggcgatgctcatgggggttggcctcttcattattatggggtcgccacgcggccattggagaggcagtgctccagtggccggatgacgctgccgcgacattaatgaggcaagggaaagagcgtcaattcagcaagcgcgtatctgtgcgtttatcgaacagcttaagcagacagccctcaagcgaacaattgggcgctgagatcgcgactggcgctgagcaggcccggcaagaagcgctgctccagctcggcgcggctgacgcggccggcatgggtgctgacgttgagcgcggccaggacctggcccgaagcgtcgtacaccggtacggcgatggagcgcaggccttgctccagctcctgatcgacgatgcaccagccctgctgccgaacctgttgcaggcattcgagcagcgcctgcggcgtgtgcagggtacggctggtcttggcttgcaggtcggcatgctcgaggtattcgcgcaacgaagcgtcatccagcgctgccagcaggatccggcccatggacgtgcagtaggccgggaggcgcccaccgaccgagagatcgaccgagatcaggcgctgggtggtggccgaacgggcgatgtacagaatgtcgtcgccttccagggtggccatgttgcaggcttcgtgcagttgctcgctcatgcgatccaggtaaggctgggccgacaccgccagcggcgtggaagacaggtaggcgtgccccagcgtcagcaccttgggcagcaacgaataggtgcggccgtcggtggtggcgtaaccgagcttgatcagggtatgcaggcagcggcgcacggcggcacggggaatctccgtgcggtggctgatctgggcaatggtcagatggcgcttgcgctcctgaaaggcctggaccaccgccaggccgcgagccagagaagtcatgaaatccggatcacccgtcagcgcctgaatccgcttggccggcgaagcgacaatcggtggcgcggcggaagcgaaggaattacgcaattgatcgttcatttcaggttctctgcgacggaagtctggcttattacaagccgtactggagaggatgcacaagcctgcacagccaacattgggcgattatcgaaccatcgaccgataatcgcaatccatcgcgataaatgccccccatgcgatgtgccactttttcgccgccaataaaactctcatttcttccgcgttagtccaggcaacttgtcaggccctgttacagaactgctctggtcatccggattaaaactttcgtgtaacaaaaccctgatatcaagttgaggatttttaacttattgccgatagagttattcatggccgccgctataatgagcaaagtgatccgacgcttttctgcgttcggcagcatcatcaggttgcatacagtaaatgacgcctcctgcagcaagcgcttgacgctcatctcatatgcccggccaatgcgctgcaaaaaagtgactgttgctacgacagctgttcttgtccggtggcgtggccgcatgcaacaagaagtggtttggcgagccccctcgcaattctggctcctttaatcgagccgagcacgaggcgctcgataaacccgatcgaggcaatgcgtatcatcgggataatctcaactcagttaggtaacactgtgacgaaagacgaactgcgcgcggaacttgagcgccaggaacaacgttacaaggaagtttacggaggcgaagtcaccacctacgccgcccaacctgagccggaacgcaaaccttggcgaaagcgcgccagcattctcgaccaggcatttacccaagaactgcaaaagatggaaaaagagctcaaggcagaacagccgtgacgctcttcgcctgaagctttcgcactgctcgatgcccttgcagataaatgccgatcgctaggtcggccgggcatccgccgtgcagccgcgggtgggccccaagggctcaaaaactgtcatggaagtgaaatttcatacaagcgtttgagacgtttggctgagtcttgcatccctggcctagaggatgagccccaataaaatcaagggcttgcccatgcctcgaaaaaaggcatggccattggcctgcctcctgctttttcgttgaagaatgttaccaaccagcacctagtgcatcgattaccagggttttctggcataatcgcgcccccttatgaccgggtcagaaaaccttcatgatcgatttattcagcggactggatgcttgggtgcttgtgagcctcttgctcgccctggcttttgtcctcgcctacgagttcatcaatggctttcatgacaccgcaaatgcggttgccactgttatctacaccaaagccatgccgccgcacctggccgtattcttttccggtgtattcaatttcctcggtgtgctgctgggcggcgtcggcgtggcctatgccatcgtccatctgctgccggtcgagctgctgatcaatgtcaacaccggccacggcctggccatggtcttctcgttgctggccgcggccatcacctggaacctgggcacctggtacttcggtattcccgcctccagctcccacaccctgatcggttcgatcctcggcgtcggcctggccaacgccctgctcaacgacatcccgctgggcgatggcgtgaactggcagaaggcgatcgacatcggtgcttccctggtgttctcgcccatggccggcttcctgattgccgccctggtgctgatcggcctgaagtggtggcgcccgatctcgaagatgcacaagaccccggaacaacgccgcaaggtcgacgacaagaaacacccgcccttctggaatcgcctggtgctggtgatctcggccatggccgtgagcttcgtgcacggttccaacgacggccagaaaggcatcggcctgatcatgctggtactgatcggtatcgtgcccgcgcagttcgtgctcgacctgaacagcaccacttaccagatcgagcgtacccgcgacgccaccctgcacctgagccaattctaccagcgcaaccaggactccctgggcgagttcctggccctgggcaaaagcgtgaaagacgacctgccaggcaagttccgctgcaacccgcaacagaccgaaccgaccatcgccgcactgctgggcaccctcaagggtgtagccgactatcactcgctgccggccgaaagccgtatcgaagtgcgtcgctacctgctctgcctggatgacactgcgaagaaagtcggcaagctgccgcacctcgcggcccgtgaaaaggccgacctggacaagctgcgcaaagacctgaccgccaccaccgaatacgcgccgttctgggtgatcctggccgtggccctggccctcggcctggggaccatgatcggctggaaacgcgtggtacagaccatcggcgagaagattggcaagcaaggcatgacctatgcccagggcatgtcggcgcagatcaccgccgccggcctgatcggcatggccaatatcttcagcctgccggtatcgaccacccacgtgctgtcgtcgggcgtggcgggaaccatggtcgccaacaaaagcggcctgcaaagcggcaccgtgcgcaccatcctgctggcctgggtactgaccctgccggcgaccgtggcgctgtcggccggtctgttctggctggcctcgaaagccctcgggacctgactcgctcggtccgcgacaaaaaaggtgcgcccctcgggccgcaccttttttatgcctgaaagaaatgatggctttgccacaaaacacacaagcaaaaaaaagggcaaccgaagttgcccaaaatgccttgcgtgctcgttaccggaaagacttaaggttttttgcgtttatgcgcatctttccagatgaaaaatccaaacccggcgaaaaacagaaccatgaggccgacagtcagcactccggcgatcaccacattgtcgaaaaacatgactggcctcctgctcttgccctgttgcgatggggctaagttaaccaaagaggcggcggggaaaattgaccggggtcaatggtcgcccaagacaggacgacagggaggggaaataactgacttacatcaacagatcgcgcccggttcagcgctttttcggctttttcggtttcttcttcggcttgcccaaaggcattgcctgctcgaatgcctggcgcacttcattcaggcgtttttccttcaggtcatgcacacgcttggcacgttcggcattcaggtcgatcaggttgtcgtcttggctcatggcgttggcttgcatcattcaggtcaatgtcaaccacagcctctatatatatagatagcgcggctgcggcccttgcgggtttgccaataatgcggcgtgacgcggcgcctgaccagtgatcggcaggtatcgagcgcaattaaaggtggaagtccgccgtatttgaccagcattgtgcggattgcggcatgtgattccttgcctcgccgttgcaggcattcaagagcgctatctaaacctcgacgtcgacccacagcccctggcgtggcgcgtcctcgatcaacggcaccaccggcacggtgttgtcggcattcaactcgtccccgggcacggccaggtgcagttcgggatcgtcctcggcctcgcgcttgcgcctttgctgctggcgctgctgttcttcgcgcagcagcagcgccgactgttcggcatcgcgcttttgcaggtcgatggtgctttcgttggaactctgttgcaccgataccaccggcgggatatccgggcgcggccggatcggatcctgctgggaggtcacgggcacggcactcaagggcagcatcgggggcagcatattattggtctcctgtcggcaggctgtcggctgctgcgggggcgacttgagccatcggtcgcaaacttgtgacccagtcgtcacccgatagtgcccaggccacgacaaatgcgcccgatacactaccttccaagcgtagttgtttttgttagagtcctttggcctgaggccgccgatccgttaacatagtcggctttttcaaggcgggagtcaggcagcatggcgcagcagtatcaaccggggcaacgctggattagtgacagcgaagccgagctaggtctaggcaccgttctggcacaggacggccgcttgctgaccgtgctctatccggccactggcgacactcgccagtatgcgctacggaatgcgcccctcactcgcgtgaggttttccccgggtgacaccatcacccacttcgaaggctggaagatgaccgtgcgcgaagtcgacgatgtcgacggcctgctggtctaccacggcctcaacgggcagaacgaagtcgtcaccctgccggaaacccaactctcgaacttcatccagttccgtctggccagcgaccgtctgttcgccgggcagatcgacccgctggcctggttctccctgcgttaccacaccctggaacacaccagccgccagctgcagtcgtcgctgtggggcctgggtggcgtacgcgcccagccgatcgcccaccaactgcacattgcccgtgaagtcgccgaccgtatcgcaccgcgggttctgctggcggacgaagtgggcctgggcaagaccatcgaagccggcctggtgatccatcgccagctgctgtcgggccgcgccagccgcgtgctgatcctggtcccggagaacctgcagcaccagtggctggtggaaatgcgccggcgcttcaacctgcaggtcgcgctgttcgacgaagaacgttttatcgaaagcgatgccgccaaccccttcgaggacacccagctcgccctggtagccctggaatggctggtggacgacgagaaggcccaggacgcgctgttcgccgccggctgggacctgatggtggtcgacgaagcccaccacctggtgtggcacgaagaccaggtcagcccggaatacgcgctggtggaacaattggccgaggtgattcccggcgtcctgctgctcaccgccaccccggagcaactgggccaggacagccacttcgcccgtctgcgcctgctcgatccgaaccgtttccacgatttggccgccttccgcgccgagagcgaaaactatcgtccggtggccgaagccgtgcaggaactgctggataaaggacgcctgtcgcctgaagcgcacaagaccatccacaacttcctcggcaacgaaggcgaagccctgctcgccgccgtcaacgagggcgacagcgaggccagcgcgcgcctggtgcgcgagctgctggaccgccacggcaccggccgcgtgctgttccgcaacacccgcgccgcagtgcaaggcttccccgagcgcaagctgcacccctacccgctgccatgcccggacgaatacctggaactgccgttgggcgaacacgccgagctgtacccggaagtcagcttccaggcccagccggacgccagcgaagaagagcgctggtggaagttcgacccgcgtgtcgagtggctgatcgaccagctgaaaatgctcaagcgcaccaaggtcctggtgatctgcgcccacgcggaaaccgccatggacctggaagacgccctgcgcgtgcgttccggcatcccggccacggtgttccacgaaggcatgaatatcctcgagcgcgatcgcgccgccgcctacttcgctgacgaagagttcggcgcccaggtactgatctgctcggaaatcggcagtgaaggtcgcaacttccagttcgcccaccacctggtgctgttcgatctgccatcgcacccggacctgctggagcagcggatcggccgtctcgaccggatcggccagaaacacgtgatcgaactgcatgtgccgtacctggaaaccagcccgcaagagcgcctgttccagtggtaccacgaagcgctgaatgccttcctcaatacctgcccgaccggcaacgccctgcagcatcagttcggcccacgcctgctgccgctgctggaagaagccgacgacggcgagtggcaagcgctgatcgacgaggcgcgcaccgagcgcgaacgtcttgaggccgagctgcacaccggtcgcgaccgtctgctggagctcaactccggcggcgctggcgaaggcgatgcactggtggaagcgatcctcgagcaggacgaccagttcgccctgccgatctacatggaaaccctgttcgacgccttcggcatcgacagcgaagaccattcggacaacgcgctgatcctcaagccgagcgaaaaaatgctcgacgccagcttcccgctgggcgacgacgaaggcgtgaccatcacctacgaccgcaaccaggcgctgtctcgcgaagacatgcagttcatcacctgggaacacccgatggtgcaaggcggcatggacctggtgctgtccggctccatgggcaataccgccgtggcgctgatcaagaacaaggcgctgaaacccggcaccgtgttgctggaactgctgtacgtcagtgaagtggtggcaccgcgctcgctgcaactgggccgctacctgccaccggccgccctgcgctgcctgctggacgccaacggcaacgatctgtcggcacgggtcgccttcgagaccctcaacgaccagctggaaagcgtgccacgggccagcgccaacaagttcatccaggcccagcgcgaccagctgacgccgaagatcaacgctggcgaagcgaagatcgccccgcgtcacgccgagcgcgtggccgaggcgcaacgtcgtctggccgccgacaccgacgaagaactggcgcgcctgaccgcgttgcaggcggtcaacccgaccgtgcgcgacagcgagctggtggccctgcgccaacaacgcgaacaaggcctggccatgcttgagaaagcggcgctgcgcctggaagcgatccgggtgctggtggcgggctgatccccctgctctgccggtaaatgaaaaggcccgcacactgcgggccttttttatggttcttcacggaatcccgggaaacacagaaacaagaacgccgatttgattgatgatgttcgtgcgagcaaacacatctaacaaaccggcgttcttatgcgtgatattaatactttccttcccttttgggagggcttttctgtcgtcacgatcaagcctgatggtgacgcgctccagatcgatctgattccccacgccacccgattcccttcctgtggcggctgccaaaaactctgttcaaccacgcatgagtactgccagcgagtcatccgcgatctgcccattcttggccgagcagtgcgcctcagcgttttgcttcggcgtgtcggctgtcgggactgtggcaaacgcatggaggccgtcagttggctggatcgctatgcccgcatgacgcgccgcctggccgatgcggtcattcaggcctgcgagcgccttcccacgctacacgtggcccaactgttcgggttgcattgggacagcgttcgcttgctgggaacgtcgcgccttgcaagcggcattgagtgttttgccaaaggcgcagccacagcgcttggtcatggacgaatttgccctgttcaaaggtcatcgttacgccagcgtagtgctggacgccgatacccggcgagtgctgtggattggcgaaggccgcagccgggcggcagtcagaccctttttcgaagagctggggtcagagggttgcgctcgcatcgaagcggtggcgatggacatgaacactgcctttgacctggaggttcgtcagcactgcccaaaagcgcgcgtggtctacgacctcttccatgtggtggccaagtatggtcgagaggtgattgatcgagtccgcgtcgatgaagcgaatcggctacgtcacgacaagcctgcccgcacggtcatcaagcaggcgcgatggctgttgctgcgcaatcggcagaacctgaaaacgccggaacaacaagtccgcctggaggatctgctggcggccaaccaagcgttgatgacggtctatttgatgaaggctgaactcaaaacgctttggacaccgagcaccgcctggggctggcgatcagcctggcgacaatggctgcgccatgcgcatgaaagcgacataccgcctctgatccagtttgccaaacgactgaagggttactggcggggcatcgtcagccgggtgcgctggccaatgcatacgggccagttggaaggcatcaacaatcgaatcaaggtcatcaagcggatggcgtacggttaccgggacagcgaattctttttcatgaagatcaagagcgtctttcccggtaatccgtgaagaaccttttttattggcttctgtagaagccctgttcaagccgccaccgcagcccccgtcggcgcccccggcaccaacccgtccttcatccgctgcgcatcgcgcacgaagcagcgcgaggccaggaacaggaacagcatggtcaacagcaacgccaccgggatcaggtacatggcgtcatgcaggccgaccgccttgaacgcctcggtcacctgcccggccccggcggcgtacatcgccgcatgggcgaagtgatcggacagcgcccccactaccaccggccccaggccaccgcccagcagatacaggccggcgaagaacagcgccatggccgtggcgcgcagacgtggttcgaccacatcctggatcgccgtgtaaacacaggtatagaagttgtaggcgaacagccagccgacactgaacaccgcgacgaacaccccgatctcgatacgcccggcatacagggcccaggccgtgcacagggtcgagatcaacatgctgaaggcggcgaacaacaaccggccattggcgacgcgctggtgaatcttgtcggcgacccagccgcccagggtcagcccgaacaggccggtcaacccgactatcaccccggtcgccaccgcggcttcctgcaacggcatcaggaagtaacgctgcagcatcggcaccaggaacgagttgcaggcgtaggtggcgaagttgaagctcagcccggccagcaccagccagagaaaggtcgggatcgccagcacccggcggatcggccggtcgacgcgctcctgggagaccttgacggtttccgccgccccgcgcttgggctccttgatgaagaacatgaacaccgccagcaacaggcccggcactgcggcgataaagaacggcgcgcgccagctgtcgaaggccttgaccatggcgccgatggtgaagaacgccaacaacaggcccaggggcaggccgagcatgaagatgcccatggcccgagaccggcggtgggccgggaacaggtcgccgatcagcgagttggcggccggcgcatagctggcctcgccgatgccgacgcccatgcgcacgagcaggaaactccagaaactgcccaccaggccgttgaccgcggtcagcccgctccataccgccaggccccagcccatgagcttgctgcgcgagccggtatcggccatgcgccccagcggcaggccggcaatggcgtagacaatggtgaaggcggtgccgatgatgccgatctggaagtcgctcaggtgccactccatgcggattggctcaatgatgatggccggaatggtgcgatcgaagaagttgaacaggttagccaggaacaacaggaacagaatgcgccaggcattcgccgcttgggtcgagttctgcatgggtcggtctctttattgttattcggccagacgcaaccgagcctggaacttgcaatctagtcagccccgccgcgcttgtctgtaataattcgtaaggctgataccaggcaatccgaagcacaggccatcgaccgcgctcgacggccgcccgaacagcgccagcgcccccgcctaaaccgccgcaagcccccggataccggggctaaagcccgacttttcaagggcttgcgcagggcctgaaaaatacctcgtgcgccccccttcccaaggccgttgcgaagcctagaatagcggccttgctgaccccctcatcaacctcctcccctttgaatacgcccatgtccgaagccagtccgtgtctgaattgcggtgcctgctgttcacactttcgtgtgtcttttttctggggtgaatgcgcctcttccggcggtacggtccccgacgatctggtggcgtccatcagccccagccgggtcgccatgctcggcaccgattgcaaaccgactcgctgtaccgcgctgaccggcgaggtcggcaaggaagtcagctgttcgatctaccaccagcgctccagcacctgccgcgagttcgaggcgtcctgggaaaatggtcaacagaacgtcgattgcgacgccgcgcgcgcggcattcgggctcgcgcccctggagccgacgctgcacttcgaacagagcgcttagctcgattggctatggactgaattccaaaatcatttaagtcaatctgccaccatcgctcccggccttgcctcggcttcctatactcactcccattggtcagccatcagggctggcccaggatgactcaagaaacggggcctgcgatggaatggcttggtctgcatttttttaccgagctccccgaaggcgggcaggtattactcacctgcagccacaaccccgtgctggtgatcctcgcctatctggtggcctgcgctggcagcttcgccaccctggacatggccgaacgggtgcgccacgtcgacctggcagccgcccagcaacgctggcgctggatcggcgccttctgtctggccggcggcatctgggccatgcatttcattggcatgctggcactgcaaatccccatcgaaacccattacgacctgccgatgaccctgctgtcgctgctgatcgcggtgattgcatcctggctggcgatgaagaccctcagccatacccagctgcaactgtggcgctacctgctggcgtcgatctggatcggcctgggcatctgtgtcatgcattatgtcggcatggcggcgatgcgctcacaagccacggcctactaccaacccgacctcttcggcctgtcgattgccatcgccatcagcgcgagcctggtcgccttgctgctgtcccgctacctgagcaatggcagcggcgtgttccaccagctgctcaaatacgcggccagcctgctgctggggggcggcatagtcgccatgcatttcaccggcatgtgggcgctgaaactggtgatgccagtggcgggcacgccttcaattgcggtggacaacaaccccttgcaactgggcctgaccatcgccgtcatcgccctgctgatcatcggcagcagcatcagcgcggccctggcggacaagaaactccagcacaaggaacaggacctgcgccgggtcaacaccctgttgagccaactggaccaggcccgggtggcgctgcaacaggtggcgcattacgacgccctgaccaacctgatcaatcgtcgcggcttcaaccagctgttcgccgaaaagctcatcgaaaagaccgtgcagagcggcatgctggcggtgatgttcctcgacatcgatcacttcaagcggatcaacgacagcctcggccacgatgccggcgacgaactgttgaaggtgattgccggccacatcaaaagctccacccgcagccatgaagacgtggtggcgcgtttcggcggagacgagttctgcatcctcatgagcgtgagccaccgcgacgaagcccagcacatggcgcaacgcatcatgaacaagatgaaggagcccatcgagctggcaggaaggcgcatggtgatgaccaccagcatcggcatcagcgtctttcccgacgatggcacaacctgcgaagaactgctcaagcatgccgacctggcgctctatcaatccaagggcagcggtcgcaacagcctgcatttcttcagcaccaacctgaagacccgggcgagcctggaactgcaactggaggaagaattgcgcaacgccctgcgccacgaagccggattgaccctgtattaccaacccatctacgacctgggcagccgcaaggtcagcaagctcgaagcgctggtgcgctggcggcatccgttgcacgggctgctggccccggatcgtttcatcgggatcgccgaagccaacgggctgattgccgaactggacaactgggtcctgcgcaaggcctgcgaggacctggccgccctgtcccgccatggctttgccgagctgaaaatcgcggtgaactgctcggccctgaacctggcgcgagaggagttggccgaagagatcgccaacgccctgagcaacgccggtgtcgcgccccagcgcctggaactggaagtcacggaaaacgccctgatgggtaacatcgacagcaccgtggccctgttgcggcagatccgcaatctcggggtgtcactgtcgatcgacgacttcggcaccggctattcgtccctcgcctacctcaagcgcctgccgctcaacaccctgaagatcgaccgctcgttcatccaggacgtgccccagtcgacccaggacaaggaaatcgtccaggcgatcatcgtcatggcccataccctgcacctgcaggtggtcactgaaggcgtcgagagcctgcagcagtacgagttcctcgcccaatacggctgcgacttcatccagggttacctgctcagccgggcgctgcccctggaagagttgcccggggtgatcgacgagatcgagcagcgcatgctgcccgccgtcgccgcggtcagccctctgacgtcggttcgcgatacaggcggatcagggtcgcgggatcctgctccagatagccctggccgccatgcaggcgcatcagttgtgcagccaatccgctgattggcgtggccgagccctgctcgcgggagaacttcaccgccccgtccagatccttgagcagggtgcgcacatgccatttgatcggttcgaagcggctttcggccatctgcggggcgagaatctgcaacggtctggaatcggcgaaaccaccggccagcgcctcggccagcaatgacgcatcgaccccggaacgctcggccagcgccaccacttcggcgatcaccagggcattgcaggcgacgatcatctggttgcaggccttggtcacctggccggcgccgacgccgcccatatgagtcacccgttgccccagattgagcaggaccgggcgcacccgctcgatatccgccgcctcgccgccgaccatgattgccaggctgccggcctcggcaccgggcgtgccgccggacaccggggcatcgacccagcccatgccggtgctgctcgccagttgcgcggccatttcccgggtggcggtcggctccaggctggaaaggtccaccagcagttggccggcccgggctccctgggcgataccctcggcaccgaacaccacctcgcgcaccacctcggtattggccaggcacagcagcaccaggtccgcggactcgcacaaccgggccggggtctgcgccagtcgcgcacccgcctccagcagcggcgcgcatttttcccggttgcgattccacaccaccaggggataacccgccgccagcagacggcgacacatgggcaagcccatcaggccaataccggcgaacccgagggtgggtaacgttgccatcatcttgcctccttttgattaaagatcaccaaaaactggccgatttatctgagcttaggaaaggattccccctagcggccgtcagacttatccctatcgctggggccaatatcgcgctgtaaagtcgcgagatcccacttgatagctctttgacatcttgtcaccgagccgaccagtccagacacacggcgcacaatgacttctaaaaacaattctgccaacgcagtatccgaactgacgctgaccccgggcagccagagcttttcagattcgaagccattgtccagctcgcgcccgcaggcgccccagcaatacctctacttcaccgaaaccaacaccgaccgcatcctcgacaacctcgacggcctgcgcgactcggtatttccccgcgcgccgcacctggaagacgagctcgaggcgcgccgcgagcaggagtttccctcggtctgcctgatcggcctgggccgctgcgggtcgaacatcgccctggatgtcgcggagctggtgtacaacgcccgcaagttctacctcaacgaattcaacaccgacgacaaggcctatgccgacaagggctacagccccgcccagtggatccgccacaacctgcgcctgggccagagcaaggccagcaagccggtgttcctggtcgagccgctggtgatgctgggcgacctggacaaggacatcgccgggcgcatccgcttctcgcgcaagggcgaaaaaagcggcttcatccgcgactacagcaaaatgaagatcatggacctctcggaagtccatgccggcggcgccggcaacgcgccgatcctcggccagtacctggccaagatcatcctcaacaaggacacgcagcgcttctccagccccgactggaaaatgatccactcgtacctgatcgactcctgcggcatcaaggccaaccagtcgcgcctgtacttctcgatcttcagcgccggcggcggtaccggttcgggcatggcctcggagttcggcctggcccagcagtactcgtacatgaacaagacgttcgacaccaagccgatcgacgagcacgacagcaagagcggccactccttcgtcttcgagccgatcttcaccagcggtatcggcgtactgccgaacatctccgatcaccgcagcgaaatgtccgaagcgttgcacatcaacgccggacgcttgctgtgcaaatacctgtcggaagaatgggacttctcctacaacttcgataacgaagacagcagcgaagccagcgtcatggggcgcatccgcccatggaacgcgatgatgctgatctccaacgacatcatgcgttatgccgaagaaagcgatgacggcaacatccagaacatcgacgtcaacgccatggagaagcacgccaaccagtacatctcccagcagatattcaacatcctcaccgcccaggcggtgaccaccgactacgaccagaactatttccgccgcgccggcatcgatatcggcgagaccatccgcctggatgccaacgacctgttcatgagcctggccggcccggtggcgatcgcctacgccgagtccgtggtcccggaaaccccggtgccgagcggcgacaagttcaaggtgttcgagaaagagccgcagcgcctgaacatcgacgacctgttcttccgctccatcgacctgccgcacttcaacaaggtgacccaggccatcgaaggcatcagcctgctgccgatcgagtccaagcgttatcgcgcggcgctggagcaatacaaggcttccggttacgacgccgccgcgctgcacgacctgcacttcttcaagaactgctcgtcggtggtgtcgatcgtctccctgcccaaggactacaagctgtcgtacatggacctgaaccggctcaagacccacctcaacagcctgttccccaataccaccctcaagcgttacgccctggtgatcggcgcctcggccaacctgtcgctgaccaccctgatcgccaagagcccgtgcctgtcggacgacttcctgaccctgatcgtggcctttatcaagcgttgcttcgcccgcaacccgtaccgcttcgacgagaccctggacaactcgatcctcgacttcatcgtcagcgaggcgttcgatgaaaaccgcatcgacgagttgctcaacgagttcgagaacccggcgaagatcctcgataccaactggtacgcgatcaagccgatgtatgagaagaagtaccgcgagctgatcaacgacaaggacaagttcgtctcgatcaacgacatccgcctgtcccgcgattgcgtgaagaaggccatcaagtacctgcgcgagatctaccgccaccgcatcggcaagaccaaggtcatctcgctgaacaaccacacgggcaggaccgcttactgaccgcctgtcgcccctgcaggtgccgccggtcgatggctttcgccagcgtccgaccgacggtttctgcaaggcgatatatagaaggacggtagtctccaggaacaatcaggcagccctcgggctgccttgcaaactgttcccattccgcttacgtcaccgtcagcctgaaacgggtggggcctttctccacgggcaacttgccatcatcctgatcgcggttactcggctacacactttcaaccggaaaaaccaggcacccttttggtgctcaaccttcgccctgcgccctttcctggaccagaatccacggcgaaaccaccaccgcccacagcagcggatcgcgctccaccagatccagcgcccgcgtcgcagacaccttgcccaccttctcggcggccagccaggcagagactttctcggcctggttctcggccatggcctcggctgcctcgatcaaatccaggctggcgtcgacccacaatagggcacccttggcgaagaacggttccagctccttccaggtaatggatgcggtttcaccaagcagcttggcatagagggtgctaggttcttgagtcatgggcctgtcccgaaaagaaatcggcgcaatgataacgtcggtgctctggcagacaaacccggttgcaattgcgtcaacgatagagaagtgcaggagagccagggattgctcgctgaatacggtcaaaaccccgccgcgattctgtctttttctttcaataaagcgacaccccctgattttgccccctggcgccagcttcccaggctaacaatcggcgctctacactgtaccggtacagttgccgggggcattttccggggatatccaagagatatctgacccggttctgctgctacggcgccaggactataaaaattacaacagtaagagtggagcactatgaataaggctactaagcagatttccaaactgtttgccgctatggttctggccggagtcgccagccattcgttcgcagctgacaccatcaagatcggcatcgccggccccaagaccggccctgtagcccagtacggcgacatgcagttcagtggcgccaaaatggccatcgaacaaatcaacgccaagggcggcgtcgatggcaagcagctccaggccgtcgaatacgatgatgcctgcgatccgaaacaagccgtcgccgtagccaacaaagtcgtcaacgacggcgtcaagttcgtgatcggtcacctgtgctccagctccactcaaccggcttcggacatctacgaagacgaaggcgtggtcatgatcacccccgccgccaccagcccggacatcaccacccgtggttacaagatggtgttccgcaccatcggcctggacagcgcccagggccctgccgccggcaactacatcgccgatcacgtgaagccgaaaatcgttgccgtgctgcacgacaagcagcaatacggtgaaggcatcaccaccgccgtgaagcagaccctcgagaagaaaggcaccaaggttgccgtgttcgaaggcatcaacgccggcgacaaagacttctcctcgatgatcgccaagctcaagcaagccaacgtcgacttcgtctactacggcggctaccacccggagctgggcctgatcctgcgccaagcccaggaaaaaggcctgaaagccaagttcatgggtccggaaggcgtgggtaacgactccatttcgcagatcgccaaggacgcttccgaaggcctgctggtgaccctgccgaaatccttcgaccaggatccggccaacgtggccctggcagatgccttcaaggccaagaaagaagacccgagcggtccgttcgtgttcccttcctactcggctgtccaagtgattgccgaaggcatcaaggccgccaagtccgaagacgccaccaaagtggccgaagccatccacgccggtacattcaagaccccgaccggcgacctgagcttcgacaccaagggcgacctgaaagacttcaagttcgtggtctacgagtggcacttcggcaaacctaaaaccgaagtctcgcctcaataaggccctgtctgactgactgccaacaaagcccacggcgtgccgtgggctttgttttacgaacgtattgggcctgttttccgtgatccggaagcccgcccacctgaaaatctcaaaaccgtcatcagcggttcgctggcaaaacctgacccgaagtggatgcagatccacggggcgcaggcgggaaaatgactccaccagtgaaatgcgtatcaggtttttaggagcgctgtaatgcctgacctctatcactttttccaacagctggttaacggtctcaccgttggcagcacgtatgccctgatcgccatcggctatacgatggtttacggcatcattggaatgatcaacttcgcccacggcgaggtgtacatgatcggttcctatgtggcgttcatcgccatcgcgggcctgaccatgatgggactcgacagtgtcccgctcttgatgaccgcagccttcatcgcgaccatcgtcgttaccagtgcctacggctacagcatcgaacggatcgcctaccgccccctgcgcggcagcaaccgtctgatcccgctgatctcggccatcggcatgtcgatcttcctgcagaacacggttctgctggcgcaagactccaaggacaaatccatccccaacctgatcccgggcaacttctccatcgggccaggtggcgcacatgaagtgctgatctcctacatgcaaatcgtggtgttcgtggtgaccctcatcgccatgctcggcctgaccctgttcatctcccgttcccgcctgggccgcgcctgccgtgcctgcgccgaggacatcaagatggccaacctgctgggtatcaacaccaacaacatcatcgccctgaccttcgtgatcggtgccgcgctggcggcgatcgcggccgtgctgctgagcatgcaatacggcgtgatcaaccccaacgccggcttcctggtcggtctcaaggccttcaccgccgcggtactgggcggcatcggcagcattccgggcgccatgctgggcggcctggtacttggggtggcggaagccttcggtgccgatatcttcggcgaccagtacaaggacgtcgtggcgttcggcctgctggttctggtgttgttgttccggccaaccggcctgctgggccgtccggaggttgagaaagtatgactaggaatcttcgacaggcgttcttcagcgccttgctggtgtgggccgtcgcctacccgatactcggtttgaaactgaccatcgtcggcatcaacctggaagtccatggcaccagccccaccaccctgatgatcatcgccgcgtgttcggtgctgatgttcctgcgggtgctcttcgaccagcagatcagcgcggcctggaagtcctcgcccaacatgccggtgatcccggccaaggccagcaacttcctgaccctgccgaccacccagcgctggatcatcattgcgttgatcatcggtgcgctggtctggccgttcttcggctcccgcggcgcggtggacatcgccaccctggtgctgatctacgtgatgctcggcctgggcctgaatatcgtggtcggcctggccggcctgctggacctggggtacgtcggcttctacgccgtgggcgcctacagctacgcgctgctgtcgcactactacggcttgagcttctggatctgcctgcctatcgccggcctgatggcggccactttcggcttcctgctgggcttcccggtattgcgcctgcgcggtgactacctggcgatcgtgaccctgggcttcggcgagatcatccgcttgttcctgcgtaacctgaccgacctcaccggtggtcccaacggtatcagcaacatcgataaaccgacgttcttcggcctgtccttcgaacgccgggccgccgagggcctgcagaccttccacgagtacttcggcatcgaatacaactcgatcaacaaggtgatcttcctctacctggtcgcgctgttgctggcgctgttcgccctgttcgtcatcaaccgcttgctgcgcatgcccctggggcgtgcctgggaagccctgcgcgaagacgaaatcgcctgccgcgcactgggcctgaacccgaccgtgatcaagctgtcggccttcaccctgggtgcctgcttcgccggtttcgccggtagcttcttcgccgcgcgccagggcctggtgacgccggagtccttcaccttcatcgagtccgcgaccatcctcgccatcgtcgtgctgggcggcatgggctcgcagttgggcgtggtcctggcggccaccgtgatgatcctgctgcctgaactgatgcgcgaattcagcgaataccgcatgttgatgttcggcgccatgatggtgctgatgatgatctggcgtcctcaaggcctgctgcccatgcaacgtccccacatggagctgcgcaaatgagccgtgagatcctcaaagtaacgggcctgagcatgcgctttggcggcctgctggcggtcaacggcgtggccctgaccgtcaaagagaaacaagtggtatcgatgatcggcccgaacggcgccggcaagaccacggtgttcaactgcctgaccggtttctaccagcccaccgccggcagcatcctgctcgacggcgagccgatccagggcctgccgggccacaagatcgccctcaagggtgtggtgcgcaccttccagaacgtgcggctgttcaaggacatgaccgcggtcgagaacctgttgatcgcgcagcaccgtcacctgaacaccaacttcctggccggcctgttcaagaccccggcgttccgcaagagcgagcgcgaggccatggaatacgccgagtactggctggaaaaggtcaacctcaaggagttcgccaaccgtcccgccggcaccctggcctacggtcagcagcggcgcctggaaatcgcccgctgcatgatgacccgtccgcggatcctcatgctcgacgaaccggccgccggcctcaacccgcgggaaaccgaagacctcaaggcgctgatcggcgtgctgcgcgaagagcacaacgccacggtgctgctgatcgaacacgacatgaagctggtcatgagcatttccgaccacatcgtcgtgatcaaccagggcacgcccctggccgacggcacgccggaacagatccgtgacaatcctgaagtgatcaaagcctacctgggggaagcgtaaatgctgcagttcgaaaacgtttccactttctacggcaagatccaggcgctgcacagcgtcaacgtcgagatccgccagggcgagatcgtcaccttgatcggtgccaacggcgccggtaaatccaccctgctgatgaccctctgcggttcgccgcaggcccacagcggcagcatccgttacctgggtgaagagctggtggggcagacctcggcgcagatcatgcgcaagagcattgccgtggtgccggaaggtcgtcgggtattcgcccgcctgaccgtggaggagaacctggccatgggcgggttcttcaccgacaagggcgattaccaggagcagatggacaaggtcctgggcctgttcccgcgcctcaaggaacgcttcaaccagcgcggcggcaccatgtccggcggcgagcagcagatgctcgccatcggccgcgcgctgatgagcaagcccaagctgttgctgctcgacgaaccgtccctgggcctggcgccgatcatcatccagcagatcttcgacatcatcgaacagctgcgccgtgacggtgtgacggtgttcctggtggaacagaacgccaaccaggcgctgaagatcgccgaccgtgcctatgtactggaaaacggccgggtggtgatgcaaggcaccggcgaagccctgctgaccgaccccaaggtgcgcgaagcctatctgggtggctgagcacctgcggcaaaaaggaacggccctgcggggccgttttttttcgcctggaaatctccccctcctgtagccgctgccgcaggctgcgatcggggcaacgccccgcacaggctgaccacccggaaggctcggtacaccgcgctgccagtgattgcgccggcctcgccgtcgatcgcagcctgcggcagcggctacaactggatttttttcgcctgggctgtaacaaaccccagcgacctttctctagaggggtaagcaggcacgaatgcctgcctacaccactaccttttctggagaaacaccatgaccgctaccactcgcaccctgtccgccgccgccctggccctggccctcggttctgccttgagcatcgccgcgctgccgaccaccgcccaggccgccgacaacatggagaaatgctttggcgtcgccatgaagggcaagaacgattgcgcggcaggcgcgggcaccacctgtgccggtaccgccaaggtcgaccaccaggccaacgcctggaagctggttcctaaaggcacctgcgagaaaaccgccagcagcacctcgcctaccggtttcggccagctgcaagcctacaaagccaagtcgtaagcaacctgcctgagtgtcgatgatgaacatggccgtaccactccccctgcatcccgccactcaggcgaccgtctccagcctgccgcaacgcgccgggctggggctcaagaccgagcactttcgccaggtcctgaaggaacagcccgatatcggtttctttgaagtccatgcggaaaactacatggtcgctggcgggccgttccatcactacctggggctgatccgcgagcagtatccgctgtcgttgcacggcgtcggcctgtcgatcggtgccgaaggtccgctggaccaacagcacctcaagcgcctggccgcgctgatcgagcgttatcaaccccagtccttttccgaacacctggcctggtccagccatggcccggtatttctcaatgacctgctgcccctggcctatgaccggccgacgctggaccgcgtctgcgaacacatcgaccaggtgcaggtcaccctgcgccgccccatgctgctggagaacccggcgacctacctggagtttcgccagtcgagcatggccgaggccgaattcatccgcgaggtgatacgccgcaccggctgcggcctgttgctggacgtgaacaatgtctacgtgtcgtgcatcaaccaccggcgcgacccgctggcctatatcgatgccctgccgctgcacgcggtgggcgagatccacctggccgggtttgccgaagacagcgacagcctgggcgaccgcctgttgatcgacgatcacggcgcgccgatcgataacgccgtatgggcgctgtacctgcggctgctggaacggatcggaccgaccgcgaccctgatcgagcgcgacaaccaggtgccggcgttttccgtgctgcaggccgaggcgcgccaggcggatgagctgctgcaatgcgccaggaggctgccatgaacacccaagccagcttcgccagcgccctgttcgactccgagcagccctgccctgcggacctgtactgcggcaacggtgccgacccggccagccgcttcgcggtgtaccgcaacaatgtgcagagctcgttgatcaacgccctggtcgattcctatccggtggtggcgcaactggtgggcgatgagttcttccgggccatggccgcgcgctacgtcaggcgcttcccgcccaccagcgccgtgctcagcgactatggccatgacttcgccgacttcatcggcggtttcccttccgccgctggcgtgccttacctggccgatgtcgcgcgcctggagcgcctgcgggttaccgcctatcacgccgccgacgcctgcccggcgccactggcgcagctcgcaacggccatggccgagccgcaaaccctggggcaattgcgcctggaactgcatccctcgctcggcctgctgaactcgccctatccggtggtcgatgtatgggccgcccaccagggcgatggcgactggcaaggcgtcgacctaaagagcatcgacctgtgccaaggacaaagcgccctggtgctgcgtcatgagctggaggtcgaggtgttcgccatcgacgccggggtcgcctgcttcatccacgccctgcgccactcacagccactgcaagtcgccgcggccaatgccttggctgtcgatccggcgttcgagccgagccaggccctggcgctgctgatcggtcgcggcgccatcactcgcctgtccccccattccgaggtctgaacatgcacacccactgcaccaatcaccacccgctcaaccatgggctgaaccgactcatccatctgctggagcgtattccccacagcctgatcgcctttatcgcgcgcttctccattgccgcggtgttctggaaatccggccagaccaaaatcgagggcctggccatcgacctgttctccgggacgttcgagctcggcatgccgcgcctggccgactcgaccattccgctgttccagagcgagtaccaggtaccgctgctctcccccgaactggccgcgcacctggcggcattcgccgagcatctgttcccgctgctgctcctggtcggtttcgccacgcgcttctcggccctggcgctgctgggcatgaccttgaccatccagctgttcgtctaccccgacgcctacccgacccacggcacctgggcggcagtgctgctgtacctgatggcccgcggccccggcaagctgtccatcgaccacctgatcgcccgccgctatcgctgagccgccgctgtagcgctgtagccgctgccgcaggctgcgatcggccccgaaggggacgcaaggtcttgagatcgctgagaaggccttcggccttatcgcagcctgcggcagcggctacaggcgcaaaccgtcaggtcagaggcgatccagcgcttcgccgctgcgcttgaaccagccgatcaggtaatcggccagcacctgggtgcgcctgggcagcccaccctgatacggatgcaccaggtacatcggcatgctgcgggtctggtaatcgcgcagcagcccgcgcaaacgcccgtcggccagttccgcctgcagcaggtaggacggtagccgggcgatccccgcccccaccagcgcggcctttttcagcaggttgtagtgattgctggcgaaaggtcccgacacccgtacccgaaacagttcgtgctgctggtgatagagccactcctcacggccgctgtaatggctgttgagcaggcagcgatgctcagccaggtccctgggcacctgtggctcgccatactgttccaggtaagccgggctggcgcaggtcatctcgtgccaggccagcagcggcctggccaccagtcgttggtcattggccacttccgaacggatcgccaggtcgaaaccgtcccgggacagatcgcgataattgttgttcagctccagctcgatctgcacctcggggtactgccgggaaaactccagcagcaggccttcgaagaaggtctcgcccagggacaccggcaccgtcagccgcaccggcccggccatgtcgtccttgagccgcgccagcgcctggcgcgcccgctcgacctggaccagcagcgcctgggcctggggcaacaaagcggcgcccgccgcggtcaggctcaagcggcgtgtggtgcgctgcaacagcaccaccgcgaactgcgtctccagggcgctgatgcgcttggacaattgccccttgctgcaccccagttgctgggcggccagggtaaaactgccggcctcgatcagcacggcgaacgccgccaggtcatccatctcgctcatggattgtttccatttgaaaaccaaatgttgcctattagcgcgctaatcatcaggaaaaaccagcactagactgcaacctcgttcaacccacgcgaggaaccgtcccatgaaaatccttctgatcggcgccagcggcaccattggttcggccgtcgacaaagagctgtcgcaacgccatgaaatcatccgcatcggccgcaccagcggtgacttccaggtggatatcagcgacagcacctcgatccgcgcactcttcgagcaaatcggccggttcgacgcgctgatctgcgccgcgggcaatgtcagcttcgcgccgctgggcgagatgagcgcccagcacttcgtcctgggcctgcaggacaagctgatgggccaggtcaacctgctgctgatcggccgcgagttcgccaacgacggcgcctcgttcaccttcacctccggcatcctcaaccgcgacccgatccgcagcggcgcctcggcggccctggtcaacggcgccatcgacggcttcgtccgcgccgccgccatcgagctgccacgcggcctgcgggtgaactcggtgagcccgaccgtgctggaagaagccatggacagctacgccccgtacttccgtggctacaaaccggttcccggcgccgatgtggcgctggcctacgccaagagcgtggaaggcctgcagactggccagacctatatcgtcggctgacccacgcctctgcaggagcgaagcttgctcgcgatagcgctgcacccggcacaccgcagcgccttcctacagagacgtaaatggatccagggttgtgatgaacggtcaggctgcgtaacgtggcggcacttgattggagacccgacgatgcgtgccgcccgttcccttgtttgtattgccctgctccccctgtttgccggttgccagatgctgtcggtgttcgatggccagtcccggacgcagtcccaggccggccagacccgcatgcagggcacgctgaccgccgccgacggccagttgctgttcaagccctgcgtcggcgagcagcgttatgtggtcaaggacaacggcggtaccagcatcctccaggaagccgccagcctggccgaccagcagggcacgctgttcgccgacctgcgcgggcatttctccccgagcaagtccggcggcgccgacagtgaagtggcgctgagccagctgtaccgcgtcgaacgctcgaacgacgcctgcagcgatcccgacttcccgcgcctgatcctgcgggccagtggcaaggccccggactggaacgtcgacgtcagcgccaagggcatgcgcatcgaacgcgccggccagccggcgctggccctgccctacctggaagagcaactgggcgacggccgtttcaacctcagcagcgaagccaacaaccgccacgtcgaactctgggtcgcgccgcagcgctgcgtggacagcaagaccggcagcgtgcagcacctgaccgcggaactgcgggtcgatggccaggtccagcgcggttgcgcctatttcggcggctcgcgcagcgactgaggcgacgggcaaccgttttaacctcacgggatccgggctttgcggcttataatcgccggtttgtaaaaccgccctgacgcattggtgcgtcccgcgaaccggaccctgtcatgttacgaatcaccgaactcaagctgccgatcgaccatcccgatgaagacctgcgccctgccatcctgcagcgcctgggcatcgccagcgaggacctgctcgacttcaccctgttcaagcgcagctacgacgcgcgcaagaagtcgtccgagctgtgcttcatctacaccctcgatctgaacgtgcgcgacgaggccaggctgctgcacaagttcgccgacgaccgtaacgtcaacccggcgccggatgtcagctacaaggttgtcggccaggcgcccgccgacctggcgcagcgcccgatcgtggtgggtttcggcccctgcgggattttcgccggcctgctgctggcgcagatgggcttcaagccgatcatcctcgagcgcggcaaggaagtgcgccagcgcaccaaggacacctggggcctgtggcgcaaaagcgtgctcaacccggaatccaacgtgcaattcggcgaaggcggcgcggggaccttctccgacggcaagctgtacagccagatcaaggacccgaaacaccacggccgcaaggtcctgcacgagttcgtcaaggccggcgcgccggaagagatcctctacgtcagcaagccgcacatcggcaccttccgcctgaccggcgtggtcgagaacatgcgccagcagatcatcgccctgggcggtgaggtgcgcttcgagcaacgggtgaccgacgtgctgatcgaagacggccagctggtcggcgtcgagctcaacagcggcgaacagattcactcgaaacacgtgatcctggccctcggccacagtgcccgcgacaccttccgcatgctccacggccgtggcgtgtacatggaggccaagccgttctccgtgggtttccgcatcgaacacccgcagtcgttgatcgacagcgcacgcctgggcaagtacgccggtcacccgaaactcggcgccgccgactacaagttggtgcaccacgcgaagaacggccgttcggtctacagcttctgcatgtgcccgggcggcaccgtggtggcggcgacctccgagccgaaccgcgtggtcaccaacggcatgagccagtactcgcgtaacgagcgcaacgccaactccggcatcgtggtcggcatcaccccggaagtggattacccgggcggcccgctggccggtatcgagctgcaggaacgcctggagtcccacgccttcgtgctcggtggcagcaactacgaagccccggcgcaactggtcggcgactttatcgccggcaagccgtccaccgccctgggcagcgtcgagccgtcctacaagccgggcgtcgccctgggcgacctggccctggccctgccggacttcgccatcgaggcaatccgcgaagcgctgccggccttcgagcggcagatcaagggttactccctgcacgacgcggtgctgaccgggatcgagacccgtacctcgtcgccgctgcgcattacccgcgacgaatcgatgcagagcctgaacgtgaagggcctgtacccggccggtgaaggcgccggttatgccggcggcattctgtcggcgggtgtcgacgggatccgcatcgccgaagcggtggcgcgcaatatcctcgggatcgaggcgtaagcctccaggggtagagcccctctgtaggagcgagcttgctcgcgatggaggccaacgataacgcggagcgtctgacacaccgcgttgtcttgacgtttttcgcgagcaagctcgctcctacaagggcgggcttgcacgctcagatgccggcgcgcaatacgctggccggcaacgcctcgccacgttccacactcgccgccacgctctcgatcaacccactcaattcgtagccctgagcggccagccaggcctgatcgtaataagtggtcgcataacgctcgccaccgtcacacaggatggcgacgatcgagccactctccccggcctgtttcatctgctgcgccgccatcagtgcgccgatcaggttggtaccgctggaaccgcccacccgccgccccaggcgctgcgccaggtaatgcatggccgccagcgacagggcatccggcaccttgaccatcgcatcgatcaccttgggcaggaacgacgcctcgacccgtggccggccgatcccttcgatgcgcgaaccgcaatccaggcgcaggctggcatcaccgctctggtagtaatcgaaaaacaccgaacgctcggcgtcggcgcagagtacccgggtgcaatgctggcgataccgcacataacgccccagggtggcggtggtgccgccggtgcccgggctggagatcagccatttgggctccgggtaacgctcgaagcgcagctgctggaagatcgactcggcgatgttgttgttcgcccgccagtcggtggcgcgctcggcgtaggtgaactggtccatgaaatgcccgccgccctcccgggccaggcgctccgactcggcgtagatctgcgtcgggtcctgcaccaggtggctcttgccgccgtagaaggcgatctgcgcgatcttttcctgggacgtggtggccggcatcaccgcaatgaacggcaagcccagcaggcgcgcgaaataggcctcggaaatcgccgtcgaaccactggatgcctcgatcaccggcgccccgggcttgagccagccgttacacagcgcataaaggaacaacgaacgcgccaggcgatgcttgaggctgccggtgggatggctggactcgtccttgaaatacagctcgatgcccggcaggcccggcagaggcaaggggatcaggtgggtgtcggcgctgcgctggaagtcggcttcgatgatccggatggcctcgcgggcccactgacggttgtcgctcatggtgttttctcgttggctcgaacgccacatggacgcagaaagatgaagtgcacccagcataggcgatccaggcacaaggaaaatcgggcgctgcaacaggcaaaagtccccggcccgtcgggctggggccggacatgttaggaaacatccccggtcgctcacaggtacagttttgaatcaattggatacacaactgctaggctggttttccagcaggccgctgctctgctgcatataacaaaaaagaatataacttttgttttaacaactaacagtacgggttagggtgtgccacctttttagttttctgatggagagcgaccttgcctctgcgtagcactttcacgcgtttctttcagttggaagctgccagcggtctgttattgattgccgctgccgtgcttgccctgatcatcaacaactcaccgctgtcctggctgtacaacggcctgctggacacacccgtggtcgcccagatcggcgccctgaaaatcgccaagccgctgctgctgtggatcaatgacggcctgatggccatgttcttcctgctgatcggcctggaggtcaagcgcgaggtcctcgacggccacctgtccaagccttcgcagatcgtcctgccgggcgccgccgccatcggcggcatggtagtgccggcgctgatctactggttcctcaacaaggacaatccgccggcgctcagcggctgggcgatccccatggccaccgacatcgccttcgccctcggcgtgctggccctgctgggcaagcgggttccggtgtcgctgaagctgttcctgatgacgctggcgatcatcgacgacctgggggccatcatcgtcatcgcgattttctactccggcgccctgtcgaccctgtcgctggtactcgcggctgcctgcctggtggcgctggtggcgatgaaccgcctgggggtggtcaagctcgggccgtacctgatcatcggcctgatcctctgggtctgcgtgctcaagagtggcgtccacgcgaccctggccggcgtgaccctggcgttctgcatcccgctgcgcacccgcaatgccgagccttcgccgctgctgagcctggaacatgcgctgcatccgtgggtcgcctacggcatcctgccgctgttcgccttcgccaatgccggcctgtcgctgcagggcatcaccgtggaaagcttcacccactatgtgcccatgggcatcgccatcggcctgctgctgggcaagaccgtcggcgtattcggcctgacctggctggcggtgaagatgggtctggccgccctccccgccggcgccaactggggccaggtgctgggcgtggcgatcctctgcgggatcggcttcaccatgagcctgttcgtgggttccctggcctttgtgcccggcagcagcgaatacgccggcatggaccgcatgggcatcctcaccggctcgctcttcgccgccctgatcggctacgcggtgacggccgcggccagccgcaagaacccacaactgccggcataaccgccggcgttgccagggctgaaaacacaaaaccccgaccagttgcctggccggggttttgttttgtcgcggttaacgcttagtgggcgacacggctggtgccgttgacgctcatgatgcgtacgcgctcgccaacgcggaacacttcgttttgtcaacctgttgtacataggcacgcatgctgccgtcgtcttcacgcacggtgatttccacgccctgggtacgggtcaggccttcctcggtggcggaaccgatcaggccgcctgccaccgcaccgatgaccgccgccacgatgctgcctttgccgccgccgatggcgctgccgccaacgccgccgaccgctgcaccggcgaggccgccgatcggggtcttggtgccttcgattttcaccggacgcagggattcgatagtgcccatgcgaacggtctgtacgcgacgcgcctcgtcacgggagtaagagtcaccggacagattggattggcaaccggtgagcaacatggccatcgtggaaaaggaagcaaccagcaaaacagacttacgcataggatcaactccaaaggacagataatcattaaactccgcagcttgacgcctgtcacggcgtcgcccggataaaatgtgttccattcagcagcagtacagactgcttgcctataaaaactcttcacacggtagcgcttatttcccgagttgcgccaccggccaaaggattttccatggattacttcatcattgtcgtgaccacccttgccggcctgtacttccattggtggctgtatgtacggatcaagcgctggatggaccgggacctggcgctgtcgctggccggcggggacgagaagaagaaatccttcatgctgcaacagctggcgaatgcccatcgccagaaagtaaaacgccgggacctgccacagtggctagaagccgccgcggccggttatcccggcgaatgacctggttcctggttcagggggccaggcgctcacgcacccagtcggcaccttgcagccggtagttcaagcgatcgtgcaaacggctggcgcgcccttgccagaactcgatgcgctccggtaacaggcgataaccaccccagtgctcggggcaatggggctgggtatcgttgaagcgctcctcggtgttcttgagcaaggcttccagctcctggcgatcggcgatcacctggctctgcggcgatgcccaggcccctaggcggctgcccagcgggcggacctggaagtaggcatcggactcctcggcggtgaccttgaccacccgcccctcgatacgcacctgacgctccagggccggccagaagaaggtcatggcggcaaaaggccgtgcggccagttgctgccccttggcgctgtcgtagttggtgaaaaaggtgaacccctgcgcatccagccccttgagcagcaggatgcggcaatgggggcgcccctcttcgtcaacggtcgccagggtcatggcgttggcctcgaccggcggctgctcggttttcaccgcctgtgcgaaccactggtgaaacagcgtgaagggctcgaccggagcctgggcttcggtcagtccgtcacgggtgtagtcgcggcgcatgtccgccagtccctgggtcattgcaggttccttttgcccgatgcctgatgaatcagttcttcgcctgttcggtcgcggccttggccggagccttggcagtggtggtcttcttggcggtttctttcttcgctacaggcttcttggctggggcttttttcgccggagcggctttcttcgcgacggctttcttcgaggaggcagcaggaacgactggtttcacatcctgtacggcaaccagttcagcctcggacggagtcggctggttgtacttgctcagcagggccagcatggtgctgcgctgggtgacgatgatttccacgcgacggttcagcgcacgcccttcggcgctgtcgttggccgcacgaggcattaccgaacccatgccgcgcagcatcaggcgatcgcgcttcaggccagtgaggctgaaaatcgcggcgacggactgcgcacggtcacggctcagcttctggttgaccgccgcggcaccggtggtgtcggcatggcccagtaccagcacggaagtcttggcgtcggtacccacggccttggccacgcgggtgaaggggctcagggtgaccggcagcaacatggccgggcgatccgggttgaacgaaccgtcgaccggggcgatcaccaccagggtgttctcgcgacgctccagttgcaggcggctgtccttgatggcttcacgcaggcgcggctcgtagtcgtccagccaggcctgggtgatttttggatccggcatcgggatgtctttcacatctgccttggtcggagacttgggctgctgattgaacggccaccaccagttgccggtctcggtcttggcgaccttcggagccacggtcgcggcatccgccttggctttggcgtcggctactggctctttgactgcgtctttgctcgtgtccttggaagggaacggccaccaccagttggtggtctcggccttggcggccggagcagcgacggaagcggttgcggtttcgaccttggctgcggcaggagcggtcgcggacttggcggtggatgtggcggcggacttggccgcggaaacttcgttggcagctgcttttgctgccggttgcacagcttccttgctggcggtcttatcggaaccgaaagaccaccaatgcccaccttctacgtcattttgtggagtttgtgcacaaccggtgacagtgaggcaaagagccaaggctaaagacttgttcgacgacatgggatatccacaaaatgagatcaaaaattacggtctctacgaaccgtacaaacagacgctttgaaagtataaaagccacagggttccttgctgatgcttttactcatgtttaggcaaaaaaaatcctgacagcaacttttttacagacaatccgacagaaccctcactaacctctgcgctcttggatccatcagtacgtacggacccagggtattggtgacaaaaccgaaggccacatcgtactcaggatcggcaaaaccgatggagccacccgctcccggatggccgaaggcgcgtgggccgagaccgaaggtcgcgttggccacctgcggctgatcaagcatgcaacccaggccgaaacgggtctgggtcaacagggtcttgtccatgccgacgctgtgttcgcgcgtcagctcttcgagcatatccgcttccagcaggctgccatcgagcaggccgctgtagaacccggccaggctgcgggcattgccatggccattggccgctggctgttgcatacgccgccattccggcttgttggtactggtcatgatcgacggcgggttggtgaacgcccgggtggtcatggccgtgggttcgcgcatggtcacttgcagcaggcgctgcgcggccgcgtcgccgacattgcccttgccccgggcgatgtgcgccacgcggtaaaactcctcgtccgccaggccgacatggaaatccagccccagcggcctggcgacccgtgccacgatggactcgccgggaccacgcccgtcagcccgccgcagcaactcacccaccagccagccataggtaatggccgcataaccatgaccttcacccggtgtccaccaaggagcctccgccgcgagggcatcgaccatggtttgccagtcgtagagcgcttccggcgccagcagctcacgcaaggccggcagcccggcctgatggcagagcaactgccgcagggtgatcgcttccttgccggccgcggcgaattcaggccaataccgggcaaccggcgcgtccagctgcaacttgccttcggccaccagttgcagggcggtgaccgcggtaaaggtcttggtgcaggaaaacaggttggcgatggtatcgctgtgccaggcctcgctgccgtccttgtcggcggtgccggcccagaggtcgagcacggtttccccgccgatctgaatgcacaacgccgcgccgcgctcctggggatcctcgaagagtgccgcgaaggcttcgcgcaccgcctcgaacttaagctcgtaatgaccctgaatctgcacccgtgactcccccagaccatgctctacaaagtggtgcgcattgttccagcccttgagggttttgggaacagaagcgagcccggtggcgatccaccggaagaactgttcagaaatcgacggacattgaacacagcacgggccggccagcccctacgtgagtgtagaggcggaccggcccgcgcgagggaagccgtaccctaaaggcctggctcagcgatcaatggccattcgccgaatgaccacctgcatggccaccgccctgccctgcgcccttgccatcatggcccggcttgccaccatcggcatgacccgcggtcttgtcgacctctgccttggccttcccggcttccttgcccaactgctcaagggcctgcaggttgctcttgcgcacgctgtcgacaaaaccctggaacggcacatcggtgatgcccaccaggccgaaatggccgttctcgccgtccagcaggcggccggtgaccggttgatcgaggtactggaaccagtgcacaccgacaatcgacggctcgttcaacgcctgcttgaggaattgggcataggccgggccgcgatcctcctcccgcaccagttcggtcacgcccccccagaatgggccgcgatcccgggagccgaagttgaactcggtgatcaggaccggcttgtccagcgtgttcagccgggcaaagtcgtaaccgtcctgtggcttgagggtgtacatgttgaaactcaacacatcgcaatactgggcgcaggacgccacggcctcgggggtgctgatggcgaagcgcccgcccagcagcaggtggttcggcgcgtgccacttcagcgaatcagagatggtcttgaagtaggtgtcggcaaagaccttctggaagtatttgaagtcggcttcgatctccggatgttccgggctaggcaaaggcggctcgaaccccgggtcttccatcagttcccaggcggtcaggttgatgccccaggccttcgacaggccctcctggttacggtacttgtcgcgcagttgcttgaggaacgcacgcttggccggcacgtcggtggtcatgcgcaacgtgccgtatgccagggcataacgcgacttggggtcatcgccggggccggcccaggccagttcgttgtcggcgaagtagccgatcagccagggatcgtcgcggtgatcgcgggcggcaatggccacggcgcgctcggtggccatggcaaaacgcggatcgaacggatcgggcatgccaccccaccagtcggtgccggtgctgatgcttgcatagtcgccgacgatcgacagcggcaaggtgtagggcacgcggtcattcaggcccaacgccggcgcgctccagttgccgatggtgttgaaaccccaggcttgcaggcgatccagggtgtggctggcccagcgcttctggtccagggccgcagcagggcaaggtgctgcggctggcggctcggtgcccggcccggcctggacctcctgggcgtcggccttggcggcgtccgccacaccggccttggtttcgcccggggtgcaaggcacgccgtaggtgcgctgcaggttggcgccatagaagtcgtaccagcgaccgacgttgtaggcgcggccctggtcggcgccattgccgccgcggttgtcgccttcgccgtaataaccggccagcggctcgccgacgttgggcagtgtcgtgaacatccactcacgaccggcgacgtaggtctggctgttgtccgccgcgaccgcattgacccccagggaatagaacggatgcccctggggcgtcaccagataccagcggccatcgcgcttctcggtacggaagaaaccactggccttgaaggctggcccgttgctccagccaccgaaggtgtccagggaggcgcgttcgcgttcggccagccaggttttcaattgctgttgttccttgttcgcagcggccttgagctgctcgtcgctggcgatcttttccggccatttggcgcgggtcgactggccgtaggcatccaccagaccaccgtaggccgccttgaccaccgcctcgccgtcctgcacgccgaaacgttcgagcaggatgctctgggcggctttcggttgatccatggacaaggtcaccgagaccacctggctgcggtccagctcgccttcgctgctggccagcagtacgcgctggccttcgaaggtcatcggcatcggcggaccggccttcatgccctggctcagcggcgaactggcaaccagcggcaccagcagggtctgcgccgggccggccggcaggtcgatgcgactgaccagggtcttgccgtcattgctctggatcttcacgtacagggtcagggcccagttcatcgcgctctggatccgcaggctcatgaccccggactgcgaccagtcccaggcaccggtctgcggggtcaggcgcaggctgggttgaatcgccggattgaaggtcacccggcgcagcacttcaccctcggctgtctgctccgcgttggcttgcggcaggctggcatccactgtcgccacctgcaccacatcggcaggccggacaaagttgaacagcgtctgttgccccgcgggcgcggcgagcagcggcgtggcgaacaacagggcaaagacagcgggtaacgaacggcgaatcatagggacctggtgctccttaacggccgatgagcggcctgtgtgcaatcagagggatatgcaatggacaacgcgaccggcccacaggccggccgcgctcaggaaatttcccggcggaacggcggcaacgcattgagaatagccttgccataacgctgggtgaccaggcgccggtccagcagggtgatggtgccgcggtcctgttcggtacgcagcaggcgaccgcaggcctggaccagcttgagcgaggcgtccggcaccgagatttccatgaacggattgccgcccctggcttcgatccactcggccaacgcggcttccaccggatcgtccggcaccgagaacgggatcttggcgatcaccacgtgctcgcagtaggcgccgggcaggtccacaccctcggcaaaactggccaggccgaacagcacgctggaatcgccgccatcgacccgcgccttgtgcttgttcagggtttcctgtttcgacaggttgccttgaatgaacacctgcttgcgccagtcgcgatcgaggccgtcgaacacgtcttgcatctgcttgcgcgacgagaacagcaccagggtgccccgcgagccctccaccagctccggcaggtcacggatgatcgccgcggtgtgggccggcgcatcccgtgggtcggcgcgcaggtcggggacgcgcagcaccccggcgtcggcgtgatggaaggggctgggcaccaccgccgtcacggcttttttcggcagcccggcacgcatgcggaagcgatcgaaactgcccagggcagtcagggtggcggaggtcacgagcgcgccataggccacgttccacaggttgcgacggagcatttccgccgcgaggatcgggctggcgttgacctcgatgtcgaacagcgagccgctttccgccagggtcagccagcgcgccatcggcgggttgtcttccgggtcttcggtggtgaaggcggtccacagttcccagttgcccgaggcgcgggacagcaggctgccgaacagcgggtaccactcttcggcctggttgctggcgatgccgatattgacctcgccgtccatgccttccttgagcaggtcggtcaggcgggtgaacaggtcggtcaggcgcgagaagccttttttcagctcgatgcccatttcgcgcatatggtcggggatcagcccgccgacaaaacggtggcgcggccgctcgcggccctccatgtcttcgccggtcttgaagtcggccagttgttcgcaggcggtgaacatgaactgttgctgggtcttgatctcccgcgccagctctggcacctgctcgatcagcttgcccagatcgcccggcaacggatgctgggccagcagtttggtgaggttcttggcggtctgctccagccagtcggcggtggaacgcaggcgggtgtagtgggcgaagtggccgatggccttgtccggcaggtggtggccttcgtcgaacacatagagggtgtcgcgcgggtccggcaacaccgcgccgccgcccagggccaggtcggccaggaccatatcgtggttggtgacgatcacgtcgaccttgcccatgccttcacgggccttgtagaaggcgcactggccgaagttcgggcaatggcggttggtgcactggctgtgatcggtggtcaggcgcgcccagtcggcgtcttccagggcggtgggccagctgtcgcggtcaccgtcccatttattgccggcgagcttctcgatcatgctggtgaacagcttctggctggcctcgtcgacctcgatcttgaagccttcctcttcgaacagctgggcggtggcggtttgcgcgtggccttcctgcaacagcatgtcgagcttggacaggcacatgtagcggccacggcccttggccagggagaaggtgaagttcagcccgctgttgcgcatcaggtcgggcaggtccttgtagacgatctgctcctgcagggcgacggtggcggtggcgatcaccaggcgcttgccggcggccttggcggtcgggatcgcagccaggctgtaggccacggtcttgccggtaccggtgcccgcttccacggccaccacggccgggtcgccagaacgccggccttcgtcgtcggtatcgacatcgcccaggaccttggccacttcggcgatcatcaggcgctggccgtaacgcggtttcaggctcttggcttcgagaaaacgcgagtaggcgccctggatcgtggttttgagttcgttgctgatcatggttcttcgggcgcgagaaacgctggataaattttcagtggttcggatcggccgctatcataccccgctaattcatcccgcgcagaacggagtacccgaatgacagcctttgcccttgcctacaccctgcatgtcctggccgccctggtctgggtcggcggcatgtttttcgcctggatggtgctgcgccccgcggcggtgacggcccttgaggggccggcgcggttgaagctgtgggcagaagtgttcccacggtttttcgtctgggtctgggtcgcggtggtgctgttgccgatcagcggcgtcggcctgatccacctgcgtttcagcggcttcgagaccgcgccgcgttatgtgcaggtgatgatgggcctgtatgtggtgatgaccgcgctgtttatccggatccagtcgttgcagctgccagcgctgcgtcaggcggtggcggccgaggactggccgacaggggccacgaccctgggcaatattcggaaattggtggggatcaatctgatcattggcctgttgttggtggcggtggcggcggcccggccgatgttctaaaagccgataccggaaaaagcatcgcgggcaagcctcgcgcctacagacagcacaatcgtgtaggagcgaggcttgcccgcgatagcgccagagtcagcagcgcctgttcgaagaccgcctacaggcgttgcacggttaccgaacccgcggggcctgccggccctgcatggccttcggcaccaggacggccgctcttgccaccgtcggcgcgatagacgaagcagcctttggacttgccaccggccccgggtttgccgcccgcaccggccacaccgccggccccaccatcgactaagaccttgatctgctccgccgggtaatcccgcggcagctcgacccgcacctgggcgcccgccgcccccggctggccatcaccgccgttgtcgccatcggcgccacgcccggcctggccccaggtgcaacccggctcctggccgttggcgccatcgaggccgacataacccggcgcgccggtgccaccgcgcgcatccaccgagagctccccggcctgcagcgaggtgatgcgcagcgtcaggttgcgtccgggcttggccgccttctcataggtccccggagccccacgggaggtgatctggctgccggcctccagatcggcatggtcgatgttcagttgcaggctttgttccgctggaacgatagcgatccgcgcttcgcgccccaggcgcaactcgccgaccttgacctcggtgaccgtggacggaatcagcaaggtgccgtagtcggccacttccaggcgttccagttgcaggctgctggtggtgttgggcaggcgcatcagggagtgggtctcgactgtcaccacctgggccaaaacctgcgggctgcacagtaccgcgagcaggcagagcttacgcatggccggcctccgcgggcttcgccgccttgaaggtctgcaggtggaaaatgccggtcaggagaatctgcaggcgatcgcgccaagggcgggcacggcccttgaggctgccgttgaacagcagcagctccatcaggtgggtcagcagcaacaggctgcctgccagattgagcaacagatgaatcggattgatcagcgggctgaccagattaaatagcaccagcaaccagaacagcagcgtcaacagcttgcccagcccccaaaacaccttcatatgcccccctttgcgaatttttctttgcgcgcacagtaccgacttcggcgagggataagccagagggcggagaaaattctcccgccgccccctgtcaagccgccctggcgcctggtgctcaacgctgaatatgcagctccacccggcggttctgcgcccgcccttcttcggtgtcattatcggcgaccggctcgctctcgcccttgccctggctggtcagtttgtccggcgtcaggccctggttcaggaggaaggcgacgacgctgctggcgcggcgttcggagagtttctggttgtattcatccgtcccctggctgtcggtgtgaccaatgaccttgatgctctgcacgtcggcgccctgcagcttggccagcaacccttgcagctggttttgggcttcgggggtcagctgcgccgagtcgaaggcaaacagcacatcgccctgatcgctgagggtgatcacctcggattgcgccgccggctcggctgccggtgcgaccgggtattgcggcagcgggcagccgcggttgtcgaccggggtattggccggggtgtccgggcaacggtcacggcggtcgaacacgccgtcatcgtccttatcaccatcctgggcgtagcagatcaagccgccggtcaccaggccgagtgccgcgccacccgcggcccagccaccgctttcaatggcgcccaggccgccgcccaccaggccgccgagcaggctgcagattggccacgtacgctggttgaggggggcagtgccgtcgctgtgggtagcacagcctgtgagcaggctgccgagcagtagaaccggcaaggcggctcgcgagagaagactcatcatgaatgctcctgtgtcaccggcccataccggtcacacaggagtaaagacccgcatgggcggctgcacaagccgcccatgccaggcaatcacgccgggcaatcagcggttgattttgatttccgtgcgacggttcatcgcccggccgtcggcggtcttgttatccgcgaccggctggctctcgccggcaccgacgaccgaaacgaaactgctgcggggtacgcccgcgctgatcaggtactcggtcaccgagcgcgcgcgcttttccgagaggcgctggttgtaggcatcgctgcccacgctgtcggtgtgcccggtcacccgcagttgcgcacttggcgcttcctgcttcaggcgcgtggcgatggtgtcgagcttggccttgtcggcagcggtcagcctggccgaatcgaattcgaagtgcacatcacggatgacaatggtctcttccttgaccaccaccacttcctcgaccaccgccacaggctctggcgggcaaccgttggcgtccacctgtacgcctttaggcgtgcctgggcacttgtcgcgactgtccggcacgccatcgccgtcttcgtcgccatcaccgtgcacccagcaataaccggccgcgacaccagcccccagcaaggcgccgtagcctgcccaggacgagctttcaatcgcgcccaacgcagccccaccgacgcccccgacagcggcgcaggtcggccagtcggttttctgcaaacctgcgcaaccagtcaacacactggttagcagaaccaagggtaatgctgtccgaactatgctcatctagttatctcctgagggaatcggcttagaaccgattgggggagtaaagacctggctttaaatctccgccagcatcaggccggcgggctttgcccctggatttgcccaggatcggctgtcatttcagacaaaacggctctaggcccgcgggtccgggcaggctagtctttgccactcaaagagtgaggaacttcgatgaccgcaggtatttcttcgcgcacgccccagcaggccctggccgccctgctcgatcgctacgccccgcaacagctgctgctgatcggtgccagtgggtttccggccctggaggcgtttcgccaggcgcaccccgaaaccgccattgcccagaccgcgcccggccccttgccggcggaactggcggcgcgccgtttcgacctggcgctggcggtcgactgcctggagcacctgcccaagcgcgacggtctgaacctgctcggcggcatccgcaacctcaacgccagccgtatcgcggtactggccgacctgaacgcctgcggctggcaggagaccgactttttctccctggccctgcaggccagcgaacgtttccagcgcgacgaacaggtcctgaccctgttcacctacgatctgcttgaatacaaacaagtgcccgactggctcaattccaggttctgggcgaatccggaaaacttcggaaagtactggtggtaatgcaatgagtacctctatttgtccctgcggcagcggcaacctgctggatgcctgctgcggccactaccatgccggccaccccgcgccctgcgccgaggccctgatgcgctcgcgctacagcgcctacgtgctgggcctggtggattatctggtggccaccacgctgccggcgcaacagagcggcctggaccgccagtccatcagcgactggagcgcgcaaagcacctggctgggcctggaagtcgaaagctcggaagtcttcggcggccagccggaacacgcctttgtcactttcaccgcgcgctggcacgacagccacggcgaacacagccatcgcgaacgctcatccttcgtgcagaacagcgggcactggtatttcatcgacccgaccgtgcaactcaaggccggccgcaacgacgcctgcccctgcgccagtgggcagaaattcaagaagtgctgcgccagctacttcgccagctgaatacccgcccctgagcctgtcctcgcgtgcgctccatggttgccatgggtctgtacgaaaagtcggcgagcgaaggtcaggcaaggcaaaaaaacaggcgaggaagcggagtgtaggggcctacatgagcattccgagcctgtttttaacgcagcatggccgagcgcagccacttttcgtacagagcctagactgggagttcaaacggagtaaccccccatggtcgttcagctgcgcgcactacggaccctcggactgctcacggtgctggcgctttcgggctgcacctcgtggttcgtcgacgacaccctcgacccgcaggtgcatctggtcaaggtcgaggtgatcaaggctaatttgctggagcagcgcctgcgcctgcactttcgggtcgacaaccccaacgatgccgacctgaccgtccgcgccctggaataccgggttcatctcggcgacgtgttgctggcggagggtgagcatgaacactggttcaccatcggccccaagcacagcgcctacttccaggtccccgtgcgcaccaacctgtggccgcagatacgccaggtagtgaaatggctgaaggaaccgcagcaaccgatcccctatcgtctggacggtttgctggaaaccggattattcatcggccatgacgtgcacctggcgcgcaaaggcgagataattcccgccgattttattccggagcaacctcgatgacccagcaaccccatgtccatggccctgactgcaaccacgatcatgaccaccacgatcacgatcacggccatgttcacggtccgcattgcaaccacgctcaccaggagccggtgcgcaacgccttgaaagatgtcggccgcaacgacccttgcccatgtggcagcagcaagaaattcaagaagtgccacggcgcctgatggcgtgacgccctgcctttatcttctgtaggagcgaagcttgctcgcgatgcaggcgcctcggaccttacggtgccaagacgttctgatcgcgagcaagcttcgctcctacaagggcgagtgaaggatctgcctggtcgtggtcaccgtcgcgtactcgccatgcagattgcccagcgacatggcatgcacctcctcggcgctgtgggcctggccgaaaaagtcggccttgtcgaaggtgtagcaggcgtcttccaccacccaggtatcgaaccccaggttgccggcggtccgcgccgtcgactccaccgagttgtgggtcgccacgccgacgatcaccagctggcctatcccggccttgcgtaaatcggcctccagggtcgtggcgcagaaggcatccggcacttgcttctggatcaccgcctcagcgcccagcggcatgaaccgctgctgaaactccactcccgactgccccggccagaacaccgactgctcgctgcgggacaggtgctgcacatggatcaacggccgcgccgtctggcgccagtaagccagcaactcggcgatgcgttcctcggcctcggggttgttacgtcgcccgagccggggatgcaggatgccctgttgctgatcgatcaggatcagcgccgcattggtctgaagctccatgctgacttttctcacgttgggtcattgaattccacgcacttcaacatcacctctccccacaggcaagccgtcgaacgtagaccggaccaccgaataccactgtttgctgtccgtagcagaatgtccttcgtttacctggagagctccatgatcgatctgtattactggaccacccccaacggccacaagatttccctgttcctcgaggaaaccggcctgccctacagcgtgcacccggtcaacattggccagggcgagcagttcaagcccgagttcctgaagatcgcgccgaacaaccggatccccgccatagtcgaccatcagccggccgacggcggcgcaccgctgtcgctgttcgagtccggggcgatcctgctgtacctcgcggaaaagaccgggcagtttctgcccaaggacctgcgtggccgtcaggaagccctgcagtggctgttctggcagatgggcggcctggggccgatggccgggcagaaccaccatttcagccagttcgccccggagaagatcccctacgcgatcaaacgctacgtcgatgaaaccgcgcggttgtacggggtgctggaccggcgcctggcggaccgggatttcgtcgctggcagcgaatacagcattgccgacatggcgatctatccgtggatcgtgtcccacaagtggcaaagccagaacctggaagacttccccaacctgcaccgctggttcaaccgcatcctcgatcgcccggcgaccgcgcgcgcctacgccatcgccgcccggatcaacccacccaaatcctgaggcccgacagcccatcgccggccggaaaaccccggtggctgctccgcttcgggcagccaccgggcggccggcgcgggctatttatccggcaacgcagaaatactctcgacccccgcttgcgcggcactcgcctgctcactaacgtagcgcctttatcgacgctaccccccgcaggagctttgccatggcctcgccagccttctcacattttcttccccggttcggcgttgccgcggcagtggccggcgttctcagcctggccggttgccagtcatggaacacccaggacagcctgccgccgacctccggcgtgcagccgctcaagggcctggcccagaacgtttcggtgcggcgcaacgccatgggcatgccgctgatcgaaagcaacaccttccacgatgcgttgttcgccctgggttacgtgcacgccagcgaccggatcaaccagatggtgaccctgcgcctgctggcccagggccggctggccgagatgtccggctccgatgcgctggacgtcgaccgctacatgcgcgcggtcaacctgaagaacagtgccggcgagctgtacaaggcctcgtccccacggatcaagcgcttcttcgaggtttacgcccgcggggtcaacgcctacctgttccgctaccgcgacaagctgccgccggacctggccgccaccggctacaagcccgaatactggaagccggaagattcggcgctgattttctgcctgttgaacttcagtcagtcggccaacctgccggaagaaatcaacgccctggtgctggcgcagaaagtcggcgccgacaagctcgcctggctgaccccaagctacccggacgaagcgctgccgctggccgagagcgacaaactcaagggtctcaacctgaatgtcccgggcctgagcgaaatcagcagcgccgccggcaagctcggcgaactcaacccgctgagcgtggccggcgccagcaactgggccatcgcgccacagcgcagccgcagcggcagaagcctgctggccgccgacagccactcgccggcgtggaacctggtgcagatccgcgcgcccaagtaccaggccgcgggcgcttcgatcgccggcctgccgatgattgtccagggcttcaacggcaaggtggcctggagcatgacctcggtcgccggcgacaaccaggacctgttcctggaaaaactcaagcgccagggcaatgcgctgtattacgaggccaacggcaaatggctgccggccgtggtgcgcaacgaaacctacttcgtcaaaggccagcggccgattcgcgaggcggtctatgaaacccgtcatggcgccctgctcaacagctcgagcaacctcaacgccggctacggcctggccctgcaacagccggaccttgcggacgacaagagcctggatgcgttcttcgacctgacgcgggcgcaaaacgtggaacgagcctccgacgccagccgcgagatccgcgccatcggcctgaacatgctgttcgctgatgccagccatatcggctggcaggtcaccggccgcttccccaaccgccgtgaaggcgaaggcctgctgccatcgccgggctgggaaggccgttacgactgggacggttatgccgacccgatgctccacccctatgaccaggacccggcccagggctggctgggcactgccaaccagcggatcatcccccacggttatggcatgcagctgtccaactcctggtactaccccgagcgtggcgaacgcctggccgagctggccggcagcggcaagcacgacgggcgcagcatgatcgccatgcagtacgaccagaccactcccttcgccgccaagctgaagaagatgttcgaagcccccggcatggcgcagcccctgaagaaagccatcgatgccctgcccgaagcagaccgcagcaaggcccgcgaggcctacagccgcctgatggcgttcgacggcaaactcagcccggtgtcggccgatgcggcgatctatgagctgttcctgcaggaaagcgcccggcagatcttcctcgacaaactgggcccggagtccagcccggcctggaaagccctggtggccaacggcgcgctgtcctactcggcccaggccgaccacctgctgggccaggaagacagcccgttctgggatgacagccgcaccccacagaaagaagacaagccggcgatcctcgcccgcagcctggccgccgccatcagcgccggtgaaagccagctgggtggcgaccgccgggcctggcaatggggcaagctgcacagctacagctggaagaacgccagtggccaggtgattcgcgggccattgcaggccggtggcgatcacagcaccctgaacagttcgccgtaccgctggggccaggacttcaatgtgacccaggcgccggcgctacggctgatcgtcgatttcggccagagcgaaccgctgagcgtgatgaacagcagcggccagtccggcaacccggccagcccgaactacctgaacggcatcgacgcctggctcaagggccagtacctgagcttgccgctgcaaccgcaaaacttcgaccgcctctacggcaagacccgcctgaccctggcgccaggcaagtaacaccggccagcccgtcctctgcacaaggggcgggctggcgcccggtaagcctcaaccccctcgctgatcccaccctgccacgctctcggcagccgcgccctttcctgcccgaaatctcccacgcgccctattgatgcaaggccttgcgcacgctcttttttggggcgctaccgacccacggcagactctcgcaccaccttttaaaacacttgttcgggactctggttcggaaattgctactttcattgagtctgacgctttgcagtaacagtactaatgcgccacaagcgctcatattggtttttagggattgaataatgaaaaaagcattgctgaccctttctgcactggctctctgcttggccgccggttccgcgctggccaaggaatacaaggaactgcgcttcggcgttgacccgtcctacgcaccttttgaatccaaggccgccgatggcagcctggtcggcttcgacatcgatctgggcaatgccatctgtgccgaactgaaggtcaagtgcaaatgggtcgaaagcgacttcgacggcatgatcccgggcctcaaagccaataaattcgacggcgtgatctcatccatgaccgtcaccccggcccgcgagaaagtcatcgacttctccaacgaactgttctccggcccgacctccttcgtgttcaagaaaggttccggcctgaccgaagacaccgcctcgctcaagggcaagactgtcggctacgagcagggcaccatccaggaagcctacgccaaggccgtgctggacaaggccggagtgaaaacccaggcctaccagaaccaggaccaggtgtatgccgacctgatctccgggcgtctcgatgcttcgatccaggacatgctgcaagccgagctgggcttcctgaagtcgccacaaggcgccgactacgaagtgagcaagccagtggacagcccgctgctgccggccaagacagctatcggtatctccaaaggtaacaaagagctcaaggaccttctgaataaaggtatcaaagcgttacacgacgatggcacctacgccaccattcagaaaaagcactttggcgatctgaatctctacagcggtaaataaggtcctggcgcccatcctcgatgggcgccttttttatcgccacaggtctctgatttatgttcgaagaacttctgcaaacccttgggctttccgccttcagcctcaaggggttcggtccattgttgctggaaggcacctggatgaccatcaaactctcggtattgtcgctgttactcagtgtcctgctcggcctgctcggcgccagcgccaaactctcgcggctgggcctgctgcgcctgcccgcccagctctacaccacgctgatccgcggcgtaccggacctggtgctgatgctgctgattttctacagcctgcaaacctggctgaccaccttcaccaacttcatggaatgggaatacatcgagatcgacccgttcagcgccggggtcatcaccctgggcttcatttatggggcgtacttcaccgaaaccttccgtggcgccatcctcgccgtgccgcgcgggcagatagaagccgccaccgcctacggcctcaagcgtggccagcgttttcgcttcgtggtgtttccgcagatgatgcgttttgccctgccgggtatcggcaataactggatggtgatgctcaaggccaccgcgctggtgtcgatcatcggcctggccgacctggtcaaggcggcccaggatgccggcaagagcacctatcagctgttctacttcctggtgctggcagccttgatctacctggtcattaccagcgcgtccaacatcgtcctgcgctggctcgaacgccgttatgccgcgggctcgcgggaggcggtgcgatgatcgagcttctgcaggaatactggagacccttcctctacagcgacggctacaacatcaccggcctggccatgaccatgtggctgctcagcgcctcgattttcatcggtttcctggtgtcgatcccgctgtccatcgcccgggtctcgcccaagctctacctacgctggccggtgcagttctacacctacctgtttcgcggcacgccgctctatatccagctgctgatctgctacaccgggatctacagcatcgccgcgatccgcgcccagcccgtgctcgacgcgttctttcgcgacgcgatgaactgcaccatcctcgccttcgccctgaatacctgcgcctacaccacggagattttcgccggggcgatccgcagcatggcccacggcgaggtcgaggcggccaaggcctacggcctcagcggctggaagctgtacgcctatgtgatcatgccgtcggccctgcgccgctcgctgccctactacagcaacgaagtgatcctgatgctgcactcgaccaccgtggccttcaccgcaaccatcccggatgtgctgaaagtcgctcgcgacgccaactcggccaccttcatgaccttcgagtccttcggcatcgccgcgctgatctacctcaccgtgaccttcgccctggtcggcctgttccgcctcgccgaacgccgctggctggccttcctcgggccgactcactagaacaaggcaaatcatcatccatgcgccaacagactcatgatctgctcgccccgctgccggggacctcgcgccagatccacagctttcacttcggccccgagcaggccgaaggcaaggtctacatccagtcgtcgctgcacgccgatgaactgccgggcatgctcgtggcctggcacctcaaggcacgcctggcggaactggaggcccagggccgcctgcgcagcgaaatcgtcctggtgccggtggccaacccggctggcctggaacaggtgctgatggacgtgccgctgggccgctacgagctggaaagcgggcagaacttcaatcgctggttcctcgacctcggcgaagaggtcggcaacgacatcgaaggccaactgggcgacgatccgcggcataaccgtgaaatcatccgcgccagccttcgcagcgccctggcgcggcagaccgccggcacccagttgcagtcccagcgcctggccctgcagcgcctggcctgcgacgcggacatggtgctggacctgcattgcgatttcgaagccgtggcccatctgtacaccacgcccgaggcctggccgcaggtcgaaccgctggcccgttatatcggttcggaggccagcctgttggccaccgattccggcggccagtcgttcgacgaatgcttcaccctgctctggtggcaattgcagcagcgtttcggcgaacgcttcgccattccccacggcagcttctcggtcaccgtcgagctgcgcggccagggcgacgtcaaccatggcctagccagcctggattgccaagccatactggattatctgagccatttcggcgctatcgccggcgaggctccgcccctgcccgagttgccctacccggccacgccgctggccggcgtcgaacctgtggccacgcccgtgggcggcctgctggtgttcaccgccctgcccggggagtacctggaagccgggcaacaggtggccgaagtcatcgacccgatcaacgatcgcgtcacccccattcattgcagctgcgccggcctgctctacgcccgctcgctgcgccgcatggccaccgccggcatggtgatcgcccatgtcgccggccgcgaagcctatcgcagcggctacctactttcgccttgaggatgcatgccccatgtacaaactgaccattgaaggcctgcataaatgctatggcgacaatgaagtgctcaaaggtgtttcgctcaaggcaaagaccggcgacgtcatcagcctgatcggcgccagcggctcgggcaaaagtacctttctgcgctgcatcaacttcctggaaaccccggacgacggcgccatgagcctggacggccagccgatccgcatggtcaaggaccgccatggcatgcacgtggccgacgccgacgagctgcaacggattcgcacccgtctggccatggtgttccagcatttcaacctgtggagccacatgacggtgctggagaacatcaccatggcgccgcgccgggtgctggggatcagcaagaaggacgccgaagaccgcgcccggcgctacctggacaaggtcggcctgctcccccgtgtggccgaccagtacccggcctttctctccggtggccagcaacagcgggtggcaattgcccgggctctggcgatggagccggaggtgatgctgttcgacgaacccacctcggccctcgacccggaactggtgggcgaagtgctcaaggtgattcagggcctggccgaggaaggccggaccatgatcatggtcacccatgaaatgagcttcgcccgcaaggtgtcgagccaggtgctgttcctgcacaagggcctggtggaagaggaaggcgcgccggaagaggtgctgggcaacccgaagagcgagcgcttgcagcagttcctcagcggtaacctgaagtaagccaggcgcctctatggacaaaggccagcccgccggtggagtccggcgggctggccttttttatgggtgggcgtcaatcaggccacaggagcgggaggcggttcgtccggcaaggttggttcgccaggctcggtcggctcggcgggttgtggggtgtccgggtcgggttgaccgggaatgccgcctgccgcgctggggtgcgccagcaatgaccaggccaggacgccgacctgattgggctcaagtctggcaagtgtggcgcttataagcggatcgatcttcatgaggcactcctgagctaagcacggtccactgtgcgcaaaccggggcagtcctctggttagagtatctgcccgctgaggaattcccgctatttgtcagatgaacgactcaggtacgcggcagggtcacgccacgctggccctggtatttgccgccacggtccttgtaggacacttcgcactcttcgtcggactccaggaacagcatctgcgccacgccttcgttggcgtagatcttcgccggcaaggtggtggtgttggagaattccagggtcacatgaccttcccactcaggctcgaggggggtgacgttgacgatgatgccgcaacgggcgtaggtgcttttacccaggcagatggtcagcacgttgcgcggaatacggaagtactcgacggtgcgggccagggcgaaggagttcggcggaatgatgcacacgtcgctcttgatatcgacgaagctgccggcgtcgaagtttttcggatcgacggtggccgaattgatattggtgaacaccttgaactcatcggcgcaacgcacatcgtagccgtagctcgacacaccgaaggaaatcagccgctccgaaccttcgccgcgcatctggcgctccacgaaaggctcgatcatgccgtgctcttgcgccatgcggcgaatccacttgtccgatttgatgctcatggcgggtgtcctgaaatagcgaggtggaaaaattctgtccggcatcttaccggggtgcgcctgcgggttcaaagtctgggccgcttttctcgctgaaagccgcaatacttgcgggctggaaggtatataccgcaccgccagtcactaaaagcgcgaatccgtcgcaaagaacattggcaggttccggaaaaagggttaaggtggcgccactgtgctgcttgtgtcactgagaatctctacacgatgttgaatttcgatccaaccatctccaagaatttttcctgctctttgcactcagtctcggccagggcttttcctgagtcgcagttaactttgtccaaggagatacaccatgtctaatcgccaaaccggtaccgttaagtggttcaacgatgaaaaaggcttcggcttcatcactccacaatccggtgacgacctgttcgtacacttcaaagctatccaatccgacggcttcaaaagcctgaaagaaggccaacaggtttctttcatcgctacccgcggtcagaaaggcatgcaagctgaagaagttcaagttatctaacttgtactgaaacagtaaaaagccccgccctcaaagcggggcttttttgtgcccggatgtttttgcttaatggcacccaggctatatgatccgccccctcggacaatcatatggaaactgcaggatgccgttcagacaccggaagttgttgagcgcagcggtgctcacactcgccctccctctcgcactcaacgccacacctcgccccgaccatccaacgatcatcgtcggcatggacagcggcgccagctacattgccaaggactcgcaacaacaacccgagttgcgacgcgcggtactgctggagctttccagcgcccatcgctgcggcagcaacgaggtttacctcacccccgaatcctcaggcatccccacggagtcgttcggccaggccctggaagaaatccagcaactgatcgatgaccagaccccactcctgctgaccctctcggactgcgacggaaaacgagcctttttcgaaaaggtccggccctgcaccgcccaggaatgcggcgggctgaccgcatccctggtcgacggcaagctctacctcgacgagcgttatgcgccgacgggccaaggccaggccgcgtacttcctgacgatgccaatgagctacgacaagcggcaaaaagcctggaacgcgaaaatcttctatgtcgaatcaggcaccctgcgccgggactatttcgtcagcgccgaggacttcgtttcgggcaaggccgttcatgcctcgaaaacctactatccggacggacaggtccgccacagcgctgcctatgacctcaatggcaaacgccagggagaggcgctgacctactccgagagcggtgtcgtggttaaacgctcgaactatcgggatggcctccttgagggctcgcagagcacctaccacgacaatggcaaagtcgccgagtcctacaactggcgccagggcaaacgcgtcgatggcgaatacctggagtacgacgagaacggcaagcgggtcgggcgcatcacctaccgggcgaatctgccggacggcccaattaccagctattacccggatggcaagatcaaagacagcggacagttcgttgccggcaagaaagtcggccccagcccgtcctattaccctgacggcacactggaaagcacagtcgattacgtggacaaccagcccgtgggttggcaaatccagtaccaccccaacggcaaggtaaaacagaagcagttcaacgacgaacacggcacccagcgcagttatgccctgtggaacgaacagggcgtgcagacgcttcagtggcaatgggatgaacagcaccgcgagcagggcgacttcaaggcgtggtacgacaacggccagctcaaggagcacaaggtctacaaggacgcgaaactcgaaggccccaccgtcacctggtatgaaagcggtcagatggagtcatctaccgattacctgaatggcaaagagcatggctggatgcgcctctggaacgaggacggcagcctgcagagcgaatgccagtaccagacgggcacccgtcaagatgcatgcagttgaggctgacataacgcagcgctattgagacaaccctcttcccgcagccaaacaaaaagtcccgccggtgcaaaccgcgggacttcttcatttcagggcctgcaagcttaccaggcgacgccaaaccccgcggtgtaacgggtcttgttgagatcgctgtccttggtgccactgatgatgtcccgttcggccttgaggttgagcgacgcccattccgtgaccttgtagcgtaggccgatctcggcatccagggcgtaatcggcaatattggacagcggccgccccacctcgccattggtaaacagctcgacccgcttgccaatcaggtaacggttgtagtcccacttcatggccagggaatagaagttgtctttaccgccatccttgtactcgtagtcggtgcggttgagcagcgaacccagggagaacgcacccaattcgttatcccagaactggtaacccggaccggtacccaccacgcgctgacgagccaggacctcgaccttgtcacgcttgtagttcaaccgcccttgccagaaccatttatcggtaaggaagcgatccagtgcgtattcgccgcgccagttgtcggtggtgaccacatcgttctggaattcgcggttgtactcgccttccgccgtgtgccgccatttgccgtggcgcgccgaggtcttgaagtcgatgtcgtagtcgtcggtgtccttttccgcccgctgataatccagcgccatgtcgacattgcccttccacaccagatcctcgaccaccggcttgggcttcatgatctgctggatgctcgccagctcgacagtcttcggcgcctcgccattggccagggtgaccttgccgtcttccgccgcgtgcagggacttggccttctcgccggtgtaggcatcctgcttgaccagcagttcctgatcgctctccagcgtcttgacctgcttccagtcgatcgggatggcaccggcatactcggtctggatcaataacttgccaccgtcgaacactttgatcttgccgctcagacggtcaccgttcttcaaccagacggtatcggcgagcaaaggcgtggcggtactgaaaacggcaaggcacagcagggttctggacaacataaacagatacaaggctcgagttcgcaaaaaaaaccggcattatccacatgaataaaacctcaggtagggactgactcgactatctatagtgagttcaattctcaattgttaataaaccctttgtcctacagacggtttacaggcctgcatcaggaaacccgaacgtgatcgaaccgctcgacgccgaccaaagccccgccgaaatccgacgcacggcgctctacctgaccctggcccaggtcccggaaggcaaggtagtcagctatgggcaactggcggaaatggcgggcctgggtcgcgcggcgcgctgggtgggacgcaccctcagccagttgcccgccgacaccaccctgccctggcaccgcgtactgggcgcgggcgggcgcataagcctgcccgtgggcagcgcttcgggcgacgaacagcgcgcgcgactgcgtatggaaggtgtctcgatcctgaacaatcgtgtggatattcggcgccatggctggcgtccggtagagcacagcggttagagtgcgcgctttgtttccgtaattcttgaggcagactccagcccatgccccgtaaaacctggcgcgccgcgctcgccgcctatgccagcccctcgacgctcgtgctgttgctgcttggtttcgccgccggcctgccctacatgctggtgttttcgacactttcagtctggttgcgcgaagctggtgtggctcgcgaaaccattggctacgccagcctgatcggtctggcctacgccttcaaatgggtctggtcgcccttgctcgaccaatggcgcctgcccctgctgggcaagctcgggcgccgccgctcctggctggtcctgtcgcaatcgctggtgctgctcgggctgatcggcatggggttctgcgatccgcaaaagcacctgtcctggctgatcgccattgccgttatcgtcgccttcgcctctgccacccaggacatcgcggtggacgcctaccgcctggaaatcgccgaagacagccgccaggccgccctagccgccgcctatatgtccggctaccgcgtcgccgccctgctggccaccgctggcgccctgttcttcgccgaaggtttcggctccaccggtttcagctataaacacgcggcctggaccggcacctacgtgctgttcggcgtgctgatgatcccggccctgctgaccaccctgttcatgcgcgagccgccggtgccgctgcgtacccagctgtcggccgggcgctacagtttcgtgcaccagctggtgtcggtgttcgtgctgatcgtgctgctggtgtccgtgccggcgatgttcacccagctgtacaacaccgacttcgccagcgtgctgttcgaaggcgccagcctgctggacctgctgctggaagaccgggcgttcctgcgcgccattctctacatcatcctgacttcgctgtgcctgtcggccatgggccgccgcggcctggccccggtgctgacgccggtcaatgacttcatcctgcgctaccgctggcaagccttgctgctgctgggcctgatcgccacctatcggatgtcggacaccgtgatgggcgtgatggccaacgtgttctacatcgaccagggcttcaccaaggatcagatcgccagcgtcagcaaaattttcggcctgatcatgaccctggtcggcgccggcatgggcggcctgctgatcgtgcgcttcggcatcctgccgatcctgttcatcggcggcgccgcctcggccgggaccaacctgctgttcctgatgctggccgacatgggccccaacctgcagatgctggtggtgaccatttccctggacaacttcagctcgggcctggccacctcggccttcgtcgcctacctgtcgagcctgaccaacctgaagttctcggcgacccagtacgccctgctcagctcgatcatgctgctgttgccgcgcctgatcggcggttattcgggggtcatggtggagaagttcggctatcacgacttcttcctgatcaccgccctgctcggcgtgccgaccctggtcctgatcgccttgcactggttccaggaaagccgccgcgccgaaccgccgcaagcgcccgaagccacacctccggccactccacccgcagctgctgccagcgaagaaccctaggaaaccccggggcacgccggccttcatccggcgccccgacctcccccggccgcaatcctgtacgccaacggttctcgcccgtacaatgcttcgtcatttctagtcttcagcaaccgacaacggcctaccatgcgcaccagtcaatttttgctcgccacacagaaagaaacgccttccgatgcggtcgtgatcagccatcagctgatgctgcgcgccggcatgatccgcaaactggcctcgggcctgtacacctggctcccgatgggcctgcgggtgatgcgcaaggtcgaagccatcgttcgtgaagaaatgaacgccgccggctcgcttgaagtgttgatgccgagcacgcagccggctgaactgtggcaggaatccggtcgctgggaggagtacggccctgaactgctgcgcttcaaggatcgccacggtcgcgatttctgcgctggcccgacccacgaagaagtgattaccgatctggcccgcaacgaactgagcagctacaagcagctgccgatcaacctgtaccagatccagaccaaattccgcgatgaaatccgcccacgcttcggcctgatgcgcggtcgcgagttcatcatgaaggacgcctactccttccacgccgaccaggcatcgctgcaggtcacctacgaccgcatgcaccaggcctactgcaacgtgttcacccgcctgggcctgaagttccgtccggtcgaagccgacaacggctccatcggcggcgccggctcccacgagttccacgtgctggccgagtccggcgaagacgacatcgttttcagcaacggctccgactacgcggcgaacatcgagaaagccgaagccgtgccacgagaaacctcgcgcccggcaccgagcgaagaactgcgcctggtcgacacccctgacgcgaaaaccatcgcgcagctggtggaaggctacaacctgccgatcgaaaagaccgtcaagaccctggtggtgcacgccgaggaagccggcaagctgatcgccctgatcatccgtggcgaccacgagctgaacgaaatcaaggccgccaaccagcctggcgtcgccagcccgctggtcatggcttcggaagccgaactgcgtgacgccatcggcgccggcgccggctccctgggcccgctgaacctgccgctgccaatcatcgtcgaccgctcggtggccctgatgagcgacttcggtatcggcgcgaacgtcgacgacaagcactatttcggcttcaactgggaacgcgacatgccggtcccgaccgtggccgacctgcgcaatgtcgtcagcggcgacccaagcccggacggcaagggcaccctggaaatcaagcgcggcatcgaagtcgggcacatcttccagctgggcaacaagtacagcaaggcgatgaagtgcgaagtgctgggcgagaacggcaagccagtcaccctggaaatgggctgctacggcatcggcgtgtcccgcgtggtggccgcggccatcgagcagaacaacgacgagaacggcatcatctggagcgacaccctggccccgttccagatcgccctggtaccgctgcgctatgaaaccgagcaggttcgcgaagccaccgacaagctgtacgcacaacttaccgccgccggcttcgaagtgctgctggacgaccgcgacaagaagaccagcccgggcatcaagttcgcggacatggagctgatcggcattccacaccggatcgtggtcagcgaccgcggcctcgccgaaggcaacctggaatacaagagccgtaccgaagccgaggcgcaagcgctgccggtggctgacgtgctgtccttcctccaagcccgtatccgtcgctgaaaccagatagagaagtcatgttcaagcgaaacaccttaagcctcggtggcgccgccttgtgcggcgccctgttgctcagcggctgtgccaaccagatgtcgcaacgcagcgagcacgaggaacgtgtcgagcgcaaattgctcgatcacagcctgcagatcgatgtcggtgaacctaaggtgcttgagctgccgcaacgccgggtacgcatccacgagcagaagaccttcgaagtcaccgagttcgaagtcacgcgtcgctacgatcgctacacgccctatcaaccctggcgggagatctacgagatcccgctgggcgcggtggccgtggtcgcgggtgtcggcgccaacgtggtcaatgtgtttgccctgggcaacctgccggacagcgtcaccaaggactggatcagctacggcgtggccgggctcaacccgttcatgaacgtgcagtcccacggccgggcgcagcagaacctggcggggatcgatgaaaggttccacaaccgctcgccaaaactgccgaactcgcgcaccagcgccagcttgctccattcgcgcaatgcctcgcagctgacgatgcccaggcgtcccagcttgtcggccgtgaccttgcccacgccatgcagcttgttgaccggcaaggccgaaacgaagtcctcgacctggtccggggtgatcacgaacaggccgttgggctttttccagtcgctggcgatcttggccaggaacttgttcggcgccaccccggccgacaccgtgatatgcagctggttggagacccggcgacgaatgtcctgggcgattcgcgtggcgctgccggcgaagttggggctgtcggaaacgtccaggtaggcctcatccagggataaaggctcgatcaggtcggtgtagtcgcgaaagatcgtatggatctctttcgacgcttcccggtaggcctccatgcgcggcttgacgatcagcaggtcggggcacagcgtcagcgcatgccgcgaggacatggccgaacgcacgccaaaagcgcgggcctcatagttgcaggtggcgatcaccccgcgtcgctccgccgagccgcccaccgccatcggcctgccggccaattgcgggtcgtcgcgcatttcgatggcggcgtagaagcaatcgcagtcgatgtggatgattttgcgctgcgtcatataaaggcagagttcatggaagcaagaggtcgatcacaagacagggcgacagtatctcaccgagaactgtatatagcaccagtagtttgacttctcctgtctgccgccagaaaaatcggaagatgaatttattttctcaatcggtcaaagcccctcaatagagctgaaagccttgtgcagcatgccctcagggccgattcagaggctgcattttcacgctaagcaattgaacgagaacagtttttttcggtcaatcggttgacaggccggcgatcctctgtagaatgccgccacacagacgcgggatggagcagtctggtagctcgtcgggctcataacccgaaggtcgtcggttcaaatccggctcccgcaaccaaacatcaaaaaaggctactcgaaagagtggccttttttgtgcgcgctcgttttgttgtcgcgccaaacaaaaccctttgcagtaccgggacttaacccgccttgcgagtcattcaacacttatttgactcaatggaccattaacggttgacactccagcattcgtctgtagaatgccgccacacagacgcgggatggagcagcctggtagctcgtcgggctcataacccgaaggtcgtcggttcaaatccggctcccgcaaccaaacaacaagaaaggccactcgaaagagtggccttttttgtatctgtcgaaaaaatcttttcgcaacaatgacctggcaacctcccgtgaaccgtcagtcaccgtccccactctttccaacccgctatgctcattgccaggcagccgcttgaaaacgctggccgtccgggctcgcagggccatggtgagacgcgttaatatttgaaactattttttctgcagggattggtaacttggctggatacccccatcctgtcgcgcacaatccacgaggtgattgatgcgcgccaactcgtctgactcacaagacaccgataccgttacagcgaaccaaccggttgcggccacccgcttgcgctggctggagctattgagcaaataccgccagccgatcggcatggtggtgaccctgctgctgttcggcatcgccctgattgcctgtcgtcacctgctcagcgagctggatctgtatgccctgcatgattcgatcctcgacgtgcccaagccggccctgctcggcgccttggccgcgaccgtggtcggtttcgtcatcctgctcggctacgaatggtccgccagccgctacgccggggtgaacctgccgccgcgcaccctggccctcgggggctttaccgcctttgccatcggcaacgccatcggcctgtcgctgctctccggcggctcggtgcgttaccgcctctatgcccggcatggcgtgggtgccggcgacgtcgcccatatgacgctgttcgccagcttgtccctcggttgtgccttgccaccgctcgcagccctggcgaccctgagcaacctgcccgccgcctccgccgccctgcgcctctccgaaggcctgctggccagcattgccggcgccgtactgctgctctgcgcgatcctggccatcggtatctaccggcgccgcctgcctgaacagccactgccggacaacctgctggtcaaggccggacgccgcaccctgcgcctgcctggacgtcgcctgacgctcctgcaactgctgatcaccgccctcgacgtcgctgccgccgccaccgtgctgtatctgctgctgcccgaggcaccacccttcggcgccttcctgctggtctacctgctggccctggcggccggcgtgctcagccatgtacccggcggcgtcggggtgttcgaagcgattctgctggccgccttcgccgacaagctcggtgcagcgccactggccgccgccctgctgctgtaccggctgatctacgtgatcctgccgatgctggtggcctgcgtcctgctgctgatcaatgaagcccagcgcctgttccagacccgtcaatcgctgcgggtggcctcgggcctggccgcaccgatcctcgcagtgctggtgttcctgtccggcgtggtgctgctgttttccggcgtgaccccggaaatcgacacccgcctgcaacacatcggttttctgatcccgcaccgcctggtggatgcctcgcacttcggcgccagcctggtcggggtgctttgcctgctgctggcccagggcctgcgccggcgcctgtccgcagcctggatattgaccaccatcctgctgctggtcggtgccgtgctctcgctgctcaagggtttcgactgggaagaagccagcctgatgaccctgaccgccagcctgctggcggtcttccgacgctccttctaccggccgagtcgcctcaccgaactgccgttctcgccgctgtacctggtggccagcgtctgtgtgctgggcgcatcgatctggctgctgctgttcgcctatcaggacgtgccctacagccatcagctgtggtggcagttcaccctcgacgccgatgccccacggggcctgcgctcgctgctgggggccgcggtgctgctggtggtggtgtccctgacctggctgctgcgcaccgcgcgcccggtgattcacctgcccaatggcgaggagctggaccgcgcggcgaagatcctcatggcctcttcccagcccgacggcggcctgtccctgaccggcgacaaggccctgctgttccatcccaacgacgacgccttcctcatgtatgcccggcgcggccgcagcctggtggcgctgtacgacccgatcgggccgacccagcaacgggccgagatgatctggcagttccgcgacctgtgcgacgtccaccatgcgcgtccggtgttctatcaagtgcgcgcggaaaacctgccgtactacatggacatcggcctgaccgcgatcaagcttggcgaagaagcccgggtcgacctgaaccgctttgacctcgaagccaagggcaaggagatgaaggacctgcgctacacctggaaccgcggtacccgcgacggtctgtcgctggaaatccatgaggccgggcaggcgccgatggacgagctgaaagtcatttccgatgcctggctgaccggcaagaatgtccgcgaaaaaggtttctccctcgggcgtttcagcgaggactacctcaagcacttccgtatcgcgatcatccgttttgaaggacgtccggtggccttcgccaacctgctcgagacctacagccatgacctggccagcctcgacctgatgcgcgcccacccggaggctcccaagctgaccatggaattcatgatggtcggcctgatccagcattataaaaaccatgggtatgcccgcttcagtctgggcatggtgccgttgtcgggtctgcaaccccggcgtggcgcgccactgacccagcgccttggatcgatggttttccgtcggggtgagcagctgtacaacttccaagggttgcgccgtttcaaagacaaattccagcctgactgggaacctcgttacatggccgtgcccgccggactggatccgctggtggcactggccgataccgccgccctgattgcgggcggcctgactggattggtgaaacgctgatgattcaacgctcctggcggtatgtattagccactctggtggtgtttgccctgatagcgggaggcggctactggtactggaatcgtccggcaccacaaccgaccctggaacacctggcccagaccgatggctcgaccctgacccgtgtcaccccggccgcccaggccaaggcccgggtcgccgtggccgtcctcgccgacgaagccctgaccgatacccaactcctggccttgagccgcggcggcgcggcgcagatcgtccaggtgatcctgcccaaggacgactgcaagctgcaggaacaagccctgcagaccgccctgggccaactcgcgggcccggcgaccctggtcagcggcatcggccctggtgccgccctggcctggcgctggatcgccacccagaacgacgacaaggcccaggccgtgtcggtgggctttaccatcaacccggccccgggctgcaccgacccgttgcccaagacgctggcccacggccactggctggtggcctggaacgacaacccggatgacgaaagcgccggcttcgtgcgtgacacccccaatgccagcaccagcatcagcgactacgacattcacctgccccaggtgctgaacaacgagctgcgcaagctgctggtgggttcggacaacggcggcctgaacatcccggtggtcgaagtgccggccggccaggccaaggacaccgtgaccctgttcctctccggtgacggcggctggcgcgacctggaccgtgacgtggccggcgagatggcgaagatcggctacccggtggtcggcatcgacaccctgcgctactactggcagcacaagaccccggaacagagcgccaccgacctgaccgaactgatgcagcactaccggcagaaatggggcaccaagcgcttcgtgctgaccggctattcgttcggcgccgacgtgttgccggccatctacaaccgcctgccggaagccgagcagcagcgggtcgacgccattatcctgctggccttcgcccgcaccggcagcttcgagatcgaagtcgaaggctggctgggcaatgccggcaaggaagccgccaccggcccggaaatggccaagctgccagccgccaaagtggtgtgcatctacggcgaggaagaagtcgacgaaagcggttgcaccgacaagaccgccgtcggcgaagccatgaaactgccgggcggccatcacttcgacgaaaactacccggccctggcccagcgcctggtcaacgtcatcgagaaacgccagggcaaggacaaggtcgccgaagagtgatctgatgcccagacaaggcccccgctgccaaccggcaccgggggctttttcatgcccctggaaacgcgcttgcagtgagttcaaaggcactcaggagcatcagccaactcacccccggcaggcagcgacgagagaaccttcccccaacaaaaaaggttcttcacggattaccgggaaagacgctcttgatcttcatgaaaaagaattcgctgtcccggtaaccgtacgccatccgcttgatgaccttgattcgattgttgatgccttccaactggcccgtatgcattggccagcgcacccggctgacgatgccccgccagtaacccttcagtcgtttggcaaactggatcagaggcggtatgtcgctttcatgcgcatggcgcagccattgtcgccaggctgatcgccagccccaggcggtgctcggtgtccaaagcgttttgagttcagccttcatcaaatagaccgtcatcaacgcttggttggccgccagcagatcctccaggcggacttgttgttccggcgttttcaggttctgccgattgcgcagcaacagccatcgcgcctgcttgatgaccgtgcgggcaggcttgtcgtgacgtagccgattcgcttcatcgacgcggactcgatcaatcacctctcgaccatacttggccaccacatggaagaggtcgtagaccacgcgcgcttttgggcagtgctgacgaacctccaggtcaaaggcagtgttcatgtccatcgccaccgcttcgatgcgagcgcaaccctctgaccccagctcttcgaaaaagggtctgactgccgcccggctgcggccttcgccaatccacagcactcgccgggtatcggcgtccagcactacgctggcgtaacgatgacctttgaacagggcaaattcgtccatgaccaagcgctgtggctgcgcctttggcaaaacactcaatgccgcttgcaaggcgcgacgttccagcaagcgaacgctgtcccaatgcaacccgaacagttgggccacgtgtagcgtgggaaggcgctcgcaggcctgaatgaccgcatcggccaggcggcgcgtcatgcgggcatagcgatccagccaactgacggcctccatgcgtttgccacagtcccgacagccgacacgccgaagcaaaacgctgaggcgcactgctcggccaagaatgggcagatcgcggatgactcgctggcagtactcatgcgtggttgaacagagtttttggcagccgccacaggaagggaatcgggtggcgtggggaatcagatcgatctggagcgcgtcaccatcaggcttgatcgtgacgacagaaaagccctcccaaaagggaaggaaagtattaatatcacgcataagaacgccggtttgttagatgtgtttgctcgcacgaacatcatcaatcaaatcggcgttcttgtttctgtgtttcccgggattccgtgaagaaccacaaaaaagcccccgccaccgctaaggtgacgagggcttctgctgttgcgcccgcttacatctcgatctgcgtacccagctcgatcacgcggttcaccggcagcttgaagaagcgcaggttgccgttggcgttcttgagcatgaaggcgaacagcgtctcgcgccagcgcgccatgccgacgatcttggaggtgatgaccgtctcgcggctgaggaagtaggtggtgcgcatcgggctgaagtccagctcgtccagatggcacagcttcagcgcttcaggcacgtccggctcgtcggtgaaaccgaagtgcaggatcacccggaagaagccttcgccataggaatccacctcgaagcgacgctgggtcggcacccgcgggatatcttcatagaccacggtcagcagcaccacttgctcgtgcagcacctggttatgcagcaggttgtgcaacagcgcatggggcacggcgtcggagcgcgcagtgaggaacaccgcggtgccctggacccgatgcggcggctgcacacgaatactgttgataaagatcggcagcggcaatgcgccctcgccgaggcggtccatcaacagttccttgccgcgtttccaagtggtcatcagggcgaacagcacaatccccgccaataccgggaaagcaccgccctggaagattttcggcacgttggcggcgaagaacagcccgtccaccagcaggaagcccagcaggatcggcaccgtcagcaccggcgaccatttccacagcaacagcatcaccgccgacaccaggatgctggtgatcagcatggtcccggtcaccgccacgccgtaggccgaagccagtgcgccggaagactcgaagcccagcaccaggaggatcaccccgaccatcagcgcccagttcaccgcgccaatgtagatctgcccctgctccgcgctggaggtgtgctgaatgtacatgcgcgggatatagcccagttggatcgcctggcgggtcagggagaacgcgccggagatcaccgcctgggaggcgatcacggtagccagggtcgccaggaccaccagcgggatcagagcccagctcggcgccagcagatagaacgggttacgcgccgcttccgggttctccaggagcaaggcgccctggccgaaatagttgagcaccagcgccggcagcaccagggcgaaccaggcacgagcgatcggcttgcgcccgaagtggcccatgtcggcgtacagcgcttcggcaccggtcaatgccagcactaccgcgccgagaatggccacgcccatgcccggatgcacgatgaagaaccgcacgccccagaccgggttcagcgcctgcagcacttccggatgctgggcgatgccgtagatccccagcccgcccagggtcacgaaccacaggaccattaccggtccgaacagcttgccgatgcgatcggtaccgtgtttctggatcagaaacagcgccaccagcacgatcagcgccatcggtacgacccagtgctcgagcccgtcgaaggcaatctccagcccctccaccgccgacaatacggaaatcgccggggtgatcatgctgtcgccgtagaacaaggccgcaccgatcaggcccaggatgaccaggaccacccgcagcctcggatagggcgtcgacgcccgccgggccagggcggtcaaggccatgatgccgccctcgccctggttgtcggcccgcaggatgaacaacacgtacttgatcgagaccacccagatcagcgaccagaagatcaatgcaaggatgccgaatacaccgtcgtggttgaccggaacctcgtaatgccccgcgaatacctccttcaaggtataaagcgggctggtcccgatgtcgccataaaccaccccgaccgccgccaccagcatccccaggggcctggccctggaatgctcgccgcctaccgcctgactacttgcctgacccatccaccactcctactacccagatcggggcttcttataaaaggcatgacattcaagacaacgccaagcttgcaagactctcgtgaatgccaatgcagcatgcgcccttttacttacagttacagacgttctgttgactataagaattcacctgggcgcaacggcgcgaagcatagcgcagcactcgtcgtatttccctgcataaagctggtcaagtgcgtcggccatcgctagaattgcgcactttttgatcagaggcgcccctagcgcccgttcgtcgccagcggttttatccagatcgccgagcggcccgacacctataccgaggttagacatgtccacccctaccgcgccagccaaccccaaggtcggcttcgtttccctgggttgcccgaaagcgctggtcgactccgagcgcatcctcacgcaactgcgtatggaaggttatgacgtggtgtccacctaccaggacgccgacgtcgtggtggtcaacacttgcggtttcatcgactcggccaaggccgagtccctggaagtgatcggcgaagccatcaaggaaaacggcaaggtcatcgtcaccggctgcatgggcgtggaagaaggcaatatccgcgacgtacatccgagcgtgctggccgtgaccggcccgcagcagtacgagcaagtggtcagtgcggtgcacgaagtggtgccgccgaaacaggaccacaacccgctgatcgacctggtgccgccacaaggcatcaagctgactccgcgccattacgcgtacctgaagatttccgaaggctgcaaccacagctgcagcttctgcatcatcccgtcgatgcgcggcaagctggtcagccgcccggtcggcgatgtactggacgaggcccagcgcctggtcaagtccggggtcaaggaactgctggtgatctcccaggacaccagcgcctatggcgtcgacgtcaagtaccgcaccggtttctggaacggcgcgccggtgaaaacccgcatgaccgagctgtgcgaagccctcagcaccctgggcgtctgggtccgcctgcactacgtctacccgtacccgcacgtcgacgagctgatcccgctgatggccgccggcaagatcctgccgtacctggacatcccgttccagcacgccagcccgaaagtgctcaaggccatgaaacgcccggccttcgaagacaagaccctggcccggatcaagaactggcgccagatctgccccgagctgatcatccgctccaccttcattgtcggcttccctggtgaaaccgaagaagacttccaatacctgctcgactggctgaccgaagcccagctcgaccgcgtcggctgcttccagtactcgccggtggaaggcgcgccggccaacgacctggacctggaagtggtcccggacgaggtcaagcaggaccgttgggagcgcttcatggcgcaccagcaggccatcagctcggcgcgcctgcaacagcgcatcggcaaggaaatcgaagtgctgatcgatgaagtcgacgaacagggcgccgtgggccgctgcttcttcgacgccccggaaatcgacggcaacgtgttcatcgacggcgccggcgacctcaagccgggcgacaaggtctggtgccgggtcaccgacgccgacgaatacgacctgtgggccgaagtcctgtaaggcgtaaaaaaccgcaaagccccgctctcttcgcgagatgcggggcttttttaggtctatcgtttgctcaggaccacggatgcgtcaccacacaggagcaggcggcatgcgccatcactcggtcatccataccccgaaacacagcgactacccggaactgacccaggtctgggaggcctcggtgcgcgccacccacgacttcctgccggacagctacatcgaactgctgagaaacctggtgctgaaccgttatctggatgcggtgatgctgatctgcacccgggaccagcgccagcacatcaccggcttcgccggggtcgccgccggcaagatcgagatgctcttcatcgatcccgcccatcgcggccagggcctgggcaagcaattgctcaggtacgccatcgaacacctgaacgccgacgaactcgacgtcaacgagcagaacccgcaagccctgggcttctacttcaagcagggcttcgaggtcatcggtcgctccgagcacgacggcatggggcagccctatccgctgctgcacatgcgtttgaaacagccccagcagcaagcgctgcgcggctaaaagccacagcgggcaaatggacccgcgattaaccggcgccgggcaggtacaatgcctgcccccttttgctacggcccctgtcatgactgacccgattcgtctctccaaacgcctcatcgaactcgtcggctgctcccgccgggaggctgagctgttcatcgagggcggctgggtcaccgtggatggcgaggtcatcgacgagccgcagttcaaggtcgacacccagaaagtcgagctcgacccgcaggccaaggccaccgcgccggagccggtgaccctgctgctgaacgtaccggccggccaggacgtcgacagcgctatgcagtcgctgagcgccgccagcctgtccgaggaacaccgcttcggcaaacggccgctcaagggccacttcctgcgcctgaccgccagcgccgatctgcaagccaatgccagcggcctgctggtgttcacccaggactggaagatcctgcgcaagctgaccgccgacgcgaccaagatcgagcaggaatacgtggtcgaggtggaaggcgagatggtcgcccacggtctcaaccgcctgaaccacggcctgacttacaagggccgcgaactgccgccggtcaaggccagctggcagaacgaaaaccgcctgcgcttcgccatgaagaacccgcaaccgggcgtgatcgcccagctctgcgaagcggtaggcctgaaggtggtcgccattcgccgcatccgtatcggtggggtttccatcggcaaggtgccggtcgggcaatggcgctacctgtccgccaaagagaaattctaggccgacacccattcagacgccgcgcgtacatgcggcgctcaacgtgaacagaccaggactgtagacatgattcataacgatgtactgcgcagcgtgcgctacatgctcgacatcagcgacaagaaggtcgtcgagatcatcaagctcaccggctttgacgtgagcctggacgacatcgtcggctacctgaaaaaggacgaggaagaaggtttcgtgcattgcccggacgaggtcatggcgcactttctcgacggcctggtgatcttcaagcgtggcaaggacgaaagccgtccgccgctgccgatcgagctgccggtgaccaacaacatcatcctcaagaagctgcgggtcgctttcgagctgaaagaagacgacatgcacgccatcctcaaggccgccggcttcccggtgtccaaaccagagctgagcgcgctgttccgcaagttcggccacaccaactaccgcccgtgcggcgaccagttgctgcgcaacttcctcaagggcctgaccctgcgcgtcaggacttaagacggctacaagctgcaagctcaaagcttgtagctcgaagcttgcaacttgaggcttgcaaaatgacctacagcgtttcccccatcggcttcgtgcgttcctgcttcaaggaaaagttcgccatcccgcgccagccgcaactggccccggcggcccgtggcgtgctggagctggtggcgcccttcgaccagggcgacgcggtgcagggcctggaacaggtcagccacatctggctgctgttcctgtttcaccaggcgctggaagacaaaccgcggctcaaggtccgcccaccgcgcctgggcggtaacaagtccatgggcgtcttcgccacccgcgccacccaccggcccaacggcattggccagtcggtggtcaagctggacaaggtcgaggccaatcgcctgtggatctccggcatcgacctgctggacggcacgccgattctcgatatcaagccctacgtgccttacgccgacatcatcgacagcgcgagcaacagcatcgccagcgcggcgccgcagttgataccggtgcagtggagcgacaacgccctgcaacaggctcatacgcacgctcaacgcctgcaggagccgctggtggagctgatcgaacaatgtttggcccaggacccacgcccggcctaccagatgcccaccccggaacgtgaatacggcgcgcagttctgggatctggacgtgcgctggcactacccgcagccgggcctgatccaggtcctggaagtggtccccgcgcgctgaccggcagccggaaacgaaaaagcccgcgctgccttctcaggcaacgcgggctttttctgtgctgcgagtcgcttacttctcgacgaaggcgcgctcgatcaggtagtcacccggctcgcgcatgcgtggcgaaacggtcaggccgaagctgttgagcacttcgctggtctcgtcgagcatgctcgggctgccgcacagcatggcgcggtcgtcctgcgggttgatcggcggcaggccgatgtcgctgaacagcttgccgctgcgcatcaggtcggtcaggcggccttcgttctcgaacggctcgcgggtcacggtcgggtagtagatcagtttttcacgcagcgcttcgccgaagaactcgttctgcggcaggtgctcggtgatgaactcacggtaggcgacttcgttgacgtaacgcacgccgtggcacaggatcactttctcgaaacgctcgtaggtttccggatcctggatgacgctcatgaacggcgccaggccggtgccggtgctgagcaggtacaggtgcttgccaggcttcaggtcgtccagtaccagggtaccggtaggcttcttgctgatgatgatctcgtcgccttccttcaaatgctgcagctgggaagtcagcgggccatcgggaaccttgatgctgaagaactcgagatgctcttcccagttcgggctggcaatcgagtaagcgcgcataagcgggcggccgttgggttgttgcaggccgatcatcacgaactgaccgttctcgaagcgcaggcccggatcgcgggtgcacttgaagctgaacagagtgtcgttccagtggtgaacactgaggacacgctcgtggttcatgttgctcatgtacgggggactcctggaaagttgtcggcgcctgctctgcgacaagcgagccgagcgcaattgcacagcattctaatggcggcgacaatatctgttaactggattattaagataagggttatcggttatatcgatatgcgatttactctccgtcaactgcaagtattcgtcgccgtcgcccagcaagagagcgtttctcgtgctgccggcctgctggccctttcccaatccgcggcaagcacttcgatcaccgaactggaacggcaatccagttgccagttgttcgatcgcgctggcaagcgcctgagcctcaacgccctgggcaaacagctgctgccccaggcggtggcgttgctggaccaggccaaggagatcgaagacctgctcaacggcaaatccggcttcggctcgttgtcggtgggcgcgaccctgaccatcggcaattacctggcgaccctgttgatcggcagcttcatgcaggtccacccggagagccaggtcaaactgcatgtgcagaacactgcgcatatcgtgcaacaggtcgcccactacgaaattgacctgggtctaatcgaaggcgactgcagccacccggacatcgaagtacaaacctgggtcgaggatgagctggtagtgttctgcgccccgcagcaccccttggccaaacgcggccatgcgagcatggaggaactgacccacgaagcctggatcctgcgggaacagggctcgggcacgcgcctgaccttcgaccaggccatgcgtcatcaccgcagcgcgctgaatattcggctcgaactggaacacaccgaagcgatcaagcgcgcggtggagtcgggattggggattggttgcatttccaggctggcgctacgcgacgccttccgccgtggcagcctggtgccggtagagacgccggacctggacctggcccggcagttctatttcatctggcacaaacaaaaatatcagacctcggcgatgcgcgagttcctcgaactttgccgcgcctttaccgccggggtgcagcgcagcgacgagatcgtgctgccgagcattccctagggtctgtacgaaaagtcggcgagcgaaggtcaggcaaggcaaaaacaggcgaggaagcggagtgtaggggcctacatgagcattccgagcctgtttttaacgcagcatggccgagtgcagccacttttcgtacagacctagatcaggatgactgcccagaccacagtgatcatgctcaaggccacgagttgcgcggcgctgcccatgtccttggcatttttcgacagtggatgtcgatccagggagatgcggtcgatcgccgcctcgaccgccgaattgagcagttcgacaatcagcgccagcaagcagacagcaatcagcaacgcccgctcgacccggctgacattcagcaggaaagacacagggatcagcacaacgttgagcagcaccagctgacgaaacgcagcttcgccggtgaaggcggcccgcaggccatcgaaggagtatcccgaggcattgaggatgcgtttaagaccggtttgacctttgaaaggcgacataaataggcaactagaacaataaggaatgggaaagctagttcaacaaaagtcaaaaaagcgtgaagaaagagccagttactggctggaaattgactcaagttgttgcaggagcagcgccgcctgagtgcgggtccgcacccccagcttacgaaagattgccgtcacatgggccttgatggtggcttccgaaacactcagctcataagcgatctgtttgttcagcaacccctcgcagaccatggtcagcacacggaactgttgtggcgtcaggctcgccaggccttcgctggccgccttggcctcggcggagacgctgacctcttcgaaggcctgtggcggccaccagacatcgccgtcgagcacgctgcgcacggcctgttgaatgacttcgagagaactggacttgggaataaaaccgctggcgccaaattcgcgtgaacgcaccatcactgatgcttcttcctgtgccgacaccatcaccaccggaatctgcgggtactgaccgcgcaacagcaccaggccggaaaagccgtaagcgcccggcatgttcaggtccagcagcaccaggtcccaatcggccttttcggtcaggcgggcttccagctcggcaatgctcgccacttccaccagacggacatccgggccgaggcccagggtcaccgcttgatgcagtgcgctacgaaagagagggtggtcatcggcaatcaggatttcgtatgtggccatttttcaaatgatcctgttttttatgggagcaccgatgcattcggtcctcgccaaggcaacacaggtgtcagccagaatgctgcacccaaagagcacgatcaacgccaagagcccggaaatgcggcgtttcaaagatcggtcgcgccctaatcggcgccaagcatgcccagcgaagccggggtggtcaagcttcgggctgtgcggcatcttagcttgctaactaataacagtgccatcatgcaaagccacgcccgcgcggctgcgcctcgatgctgagcgggatgctggtggcacagctctcgccgaaaaattccagccccttgcctcaggtcttacagaaaaggcttgaggcgcgtgtgcgtctcatcatcgggatcgatctcaagctggaacttggccgacagataatgggtgctgaacacatccagataagcatccagcacttcgccggcctgccggtccgcggccaactccaggcacagcgccgcaacctccgcggtacagaaatggtcatcgcgcttggagcgccgcagcttgtagcgcgacaactgctcgggctccaggctcaataccggcaaatgctcaagataagggcttttgcgaaacatcttgcgcgcttcgctccaggtcgcatccagcaggataaacaacgggcgcttgcccgcctccaggcggacttcgctcaccacccgctgtggcgcgacgaactctccggggaacaccacataaggctgccattggggatcggccagcaaggccagcaattgtgggtcgacttctgttcgcgaccaggggaacgccatggtgtcttctatgacatcggcgatcagccagccggtattgctcggcttcatgggttcgacgtcatgcatgatcaggcacatcgccgactgcgcggaaaccttggggcgccaggcgcacatgcagtggctgggaatcacccgacagcccgcacagcgctccgcccgggaacctcgtgcagtaaaaggtctgacggcacgcgcaagacgttgagcacgcaggcgggatacggcatgactcattagaagccgccctggcagaaagaaggaatcgacacgaaaagaactcggaaagctgaaaattcgcacaagtttatcagagctctctgctcaaacctgtaccgcctaccctcgctcccctataattcgccgccactgaacgcacagtcgcgtgactggtcgaagtatcagtcactgaaccaggagagtttcatgttgcgctttatcgttcccaccgccgcccttctgctggccttgccgttcagtgctcaggctgcatcgctgcaagacttcgaactgaacaagaccctgcagaaaaccgccgaggaaagtaacgtcggcacgcctcgggaagtcaacgagaacatcctcgaccggggttataccgtcgaaggcaaggagctgatcaaccacctcagcgtccaggccgaacacgcggaaaaaatgcgcgccaaccccaaggcggtctacttgcaactgggtgccagcgtttgccgtgacccgaactaccgcaagctgatggccaagggcgcgatcatgcgctacgaattcaccgagaaccgcaccaaccgcccggtcgcctcggcgcgcttccaggagtcggactgcccggccccgacgaagaagaaaaagtaattcagtgtcccgctgcgtgccgctgttgatcatcggcccgcagctccgccaacagggcctgcaaatagctcgaacggcgttccccaccttcaagccggcgtcggcattcctcttcaagagtcagatgattggcgtctgccgctgacttcagcagttgatacagctgcgcatctatttccagtacgactttgtacatgaccagcctccgtgccctactcgccattacctgcgcgacaaccccgacctgtgcatcctgccctttgacggcaagctgtcttgctagcgctgtaacttagtaaatcagagcctccaccggtcgacatgcgttcagacaggcggtgaatacgctgcacgccaccgctaataagtgattgccagccccgactttcaaggcccatgatcaagtcagcgcgaatcatcatgaaggtctagatttcaaagtgttcatgctgaattttcctgggtggatccggaggccgcccaagcgcgtcttgcagtgcacatgctttctaaatcaaggaatagcagaacctgtatggatggcccgctggccacgtcagggtttttccaccctggcgaatcagccgccaaagccgggctgacagcgacacatgcagtgtcgtgataccaacgaatgcttcgttcgtgtcaaaggttctgtgcagaaggagaagttgaatgccttacgaaccgaatgacctcctcagtcgtcattttcagagcaacggtatcgacctcagcaaggtcgaagaacaactcaacctgatcgctcccaacagccccaacattcctctttatcgcgacatgattctcaccgtcctgcgcatggcccaggacgatctcaaccgctggaacgcaaaaatcaccctgcaggccctgcgcgaactggaacatgctttccgcgtgctggaacagttcaaggggcgacgcaaggtgacggtatttggctccgcgcgtaccccgatcgaacacccgctgtatggcctggcacgagaactcggcgcggccctggcccgctccgacctgatggtcatcacgggcgccggtggcggcatcatggccgcggcccacgaaggtgccggtcgcgatcacagcctggggttcaacatcaccctgcccttcgagcagcatgccaacccgacggtggacggcacggagaacctgctgtccttccacttcttctttacccgcaagctgttcttcgtcaaggaagccgatgccctggtgttatgcccgggtggctttggcacgcttgatgaggcgctggaagtactgaccctgatccagaccggcaagagcccgttggtaccggtggtgctgctggatgtcccgggaggaaccttctggcaaggggcgctggactttatccacaaccagctcgagaacaaccgctacatcctgccaaccgacatgaagctgatgcgcctggcgcacaataccgaggaggcggtcgaagaaatcaaccagttctacagcaacttccactccagccgctggctgaaacatcagtttgtcattcgcatgaatcacaagctcagcgaaccggcgctcgagcagatgcagacggcttttgctgacctgtgcctgagcgatcgcttccatcaacatgcctacaatgtcgaggaacacaacgaaccggagttcagccatctggcacgcctgtcgttcaccttcaacgcccgcgacaatggccgcctgcgcgaactgatcgacttcatcaacctgccggaaaactgggcggtgaatcaggccaaggcgcaacaacgcacgagagaaccgatcaaggtcacttgagcccaaaagcagaggcccgcgcattcgactcgcgggccctacaggtcaatcgtccacccttcggccgctcagcaagcggccgatcatgtccatcgaatatccccgataccccagaaagcggccttgtttggcacgctccttggcatctatcgggaaatgcccggcaaacttgcgccgccagacatcctccagttgtgcttgccagtcgatgccgctctcacgcaaggcgagttcgatatcggcacgctgcaaaccgcgctggctgagttcttcgcgaatacgcatggggccgtagccggaacgggcacgataggaaacgaaactttcgagatagcgggattcggatagcagcccctcttccgtcaaacggtcaagggcggtttcgatcatatcgggagaggcgccgcgctgacacagtttacgcgtcagctcgactcgaccgtgctcgcgtcgcgcgagcaggtccattgcggttcgccgcaccgcgacgagggtatcgagtacggcggtcatcggatcgatcagatatccgcgtcggccatgtcatcgatggtctcgttgaccggcgaagctttgacatcagcggtcggagccagcagcttgtcgcgaatctgcttctcgagggcattaccgatttccgggttgtcctgcaggaacttggccgagttggccttgccctgaccgatcttgttgccctggtagctgtaccaggcaccggacttctcgaggaaaccatgcagcacgcccagatcgatgatctcgccgttcaggtagatacccttgccgtacaggatctggaattcagcctggcggaacggtggagccaccttgttcttgacgatcttgacccgggtttcgctaccgacgacttcgtcaccttccttcaccgcgccagtacgacggatatccagacgaaccgaagcgtagaacttcagcgcgttaccaccggtggtggtttccgggctgccgaacatcacgccgattttcatacggatctggttgatgaagatcaccaggcagttggcgttcttgatgttgccggtgatcttgcgtagcgcctgggacatcaggcgggcctgcaggcccacgtgcatgtcgcccatctcgccttcgatctcggccttgggcaccagtgccgccacggagtcgatcacgatcacgtcgatggcattggagcgcaccagcatatcggtgatttccagtgcctgttcaccggtgtccggctgggaaaccagcaggtcgtcaacgttgacccccagcttgccggcgtattccgggtccagtgcatgctcggcgtcgacgaaggcgcaagtggcgcccatcttctgtgcctgggcaatcacggacagggtcagggtggttttaccggacgattccggaccgtagatttcaacaatacgaccctttggcaggccgccgatgccgagtgcgatgtccagacccagagagccagtggaaatggccgggatcgcctggcggtcgtgatcgcccatacgcattacggcacccttgccgaattgacgttcgatctgacccagggccgcagccaaggctttcttcttgttgtcgtccattaaagtcctcacgtaatcaataaggcctgacggccaacacctgtataagtagccagtattattccacagcgttcgtggatcgcctacccctgttttgagatttctgccgcggcatgttgcagcaagccctctagcgcggccttcaccgtttgtcggcggacgtcgtcccgattcccggcaaagtgtcggcactcggccgttaccgcctctcccacgccccaggccagccatacggtgcccaccggtttctgcggcgagccgccgtccgggccggccacgccgctgaccgccacggcaaaacgcgccctgcttttgccttgcgcgccccgcaccatcgcctcgaccacctcgcggctgaccgcgccgacggaagcgaacagtgcttccggcaccgccagctgttgggtcttctgccgattggagtaggtcacataacccgcttcgaaccaggccgaactcccgggaatgcgggtgatggcctcggcaatcccgccaccggtacaggattcggccgtggtgacgtgggtattcagaatctgcaagcgcctgccaagttcagcggcaagctgggtgatttcgttcacggtcctctcctgatcgggttggcggaggtcttaccgtacacgagcgatacgcgcttgcaaggcacggagcggatcaaaatgtttagcggttcaacgccctgacgtaggcctggcacgcctgcagggcgatcagtccccggtcgccggcatcggtgatgccgataattcgttgagcatgcgccgggtcaagtcgggctcgcggggctccatgaaccaggccgccggcggcgggggtggcaggcactgtgcagccggcggcgcggtcatgggcgtcgaggaggactgacaggcgcagatcagcagtggcaagacggtcgcgcaggcgaccttgatcacgttgggcatcgctcaaggctcggtaatgggtttggtcgctggcttgcagctgttgctccagggccaggcgtttgtcctgctcgtcccgctgccgggcagcggccgccaggttcaactgattcagcgcttcgccgtgcaacctggcctgctccgccagttgccggccaaaacgccactcctgaacctgccaggccagcgtccccgcgacgccggccaccacagccagcagcacgacgacagccattgcccgggaagacagaggcatcaggccgaaggctggcataacacctcccgcgcccgcgcccagagctgcagacgatcctccagcccgttcaggccgccgttgatacgacgggtgatgctgttgaactggtcgcggtcggccagttcgttaagaccgttctgctgccagaaccaggcggccgactcggcggcccactgcggctgttccaacaattcgggcaacgccagcaaacgctcgtcgccgaacaatccgaggctgcattgccggtaattgtcgcgaccggtgacctggatcagaccacggccgcggtatttctggccgtcgccatcggcctccggggtattgcccagacgggccgccaggctgccggtgtcgtatttgctcaggtactggtcattgcccaactcccgcacataacgcaactgccccgactcatgaccgacctgcgcgaggaaggcggccatgcgtttgggcgtgttgatatggcggttcagcatggcggtgttaagcgcagaaacaaaaacgcccgcttgggagcgggcgttgggcatgatgcgttgaatcatttcaagggtgacaggcatttcactctacctcctctgcgtcgaggacgttcggaacaaacagggtcatttgtgctcctggagaacactttcaagccaggttggctcgacaggtcgatattcaacatcaggaaagtcgacagctgaaggccagtcccgcaacgcctgcctataagccagaagctccttgaactgctcggtattcagcgtcgtcccttcgcccatttccagctcttcgttgtcacgaataaccagccactgagtcgactccaaaatcttgttacgccaggccctttcaacctcaggagtattttgggatgccgaggaaatacgctcgggaaaacctttgctattcagggataaaaccgtaccagacagtgcctcaattaccagtgactcatagtctttatcactgatcacgaaggcgtctactggaatatttttcccgtgcagttctgagttatagaaaccgaaagtttcaggagaaaagtaatacatattcaataccctatgccaataacccgggcggcgatagtttgcgacggccaatcggggcaacgtacattaatcccggtaagactgcttgctcccggaggattgcagaccgttagaaaggttccagaagctgtcccttcatgagtggcaactgcaagaaaacgcgcagtgggaaatgccagaggccaagggttgtactctccgtagctattattggcagtctgacttgcactccccgtgatccattgaatgatcaggccgcccatccatgaaggaaaaacaatgtacccggaagcccccattcttatcagaaagcccaatcgaagctttttaggagtcacgacagaagtgtcacttgcaccggcattgacttccgcctgcgaagccactttggcaatacctgcgatagactccgatgcctggaccaacttcttggcaatagcctgaaacacgcgtaatggcgacatggttttggcagtattgattccggcttccgcctcttcctgagtagccagattttcactttgtttctttgaaatcaaagcagaaatcgccgctttcagttgcgagttgtcagactcattcggcgtatcccctgctgctcgaataacctccagaacttcctgtgtaacagcattcccccaatcagccggaatcaaagaccctggcatacccgtgaggggattttcatcgacaaactttccgtttaccaaaccggcactcggtacactctttgggtagtccactgtctagccctcatacaaattaaacataaaaaacttcagcattcggcaaagcccaatacagagtcgacaaactcaaacggactcggtcatctgcaccggctttctcaccctctttcttttcaccgtcgctcctgtagtgccggaagtcattcgcagcacggggcgatctgttacggcaggaaactttcgggactttggccagctgcgcaaatcgcagcgataggcttgcagggcgttgtagtcggcatcggacaaggtggtggcggcttgagattccagctcatcacgatgtctggcgaccagggcatcgctcttgagcaactccgagtcacgccaggcgcgctcaattgaaattaattgttcaggcgagggaccggcagggtcgacaagaatgggcgcaccgttgtcattggccacaatccgcttgcccacgccctgcccggcaaagagttcggcatattcagcctggctgatttccaccgcgccttctggcggagcctcgtttgcagaggtgacaacatcgaaaccgagggttttcgcaaagaaataaatcttcatggttatcgcccccaaaccagtacgcgaccagatatgcccgagttcactctgatggttccaccaacctcgacccatctggcccgggcgacagctgttgacgtgcttgatgacgttacgtcgaatgaccagacggtaacgttgcctccccagcctggcggatgaccttcatcagcgatgcctcccaatatggcattgggaaactttatgggcagcgacagagacatgaccccattggcatcggttccacccatcgcccattgcatgatcagcccgctcgggtacttctgataacccgccgtcgacaactgagccccatacaaggcggagtacttgaggctagccgtaccataaacggtccagactccccactcccgaaccagattcgcactttcaccactgctcatcacgatggagttcagatagttcccttgtggactgatctgcgcaccgctcttgctagccacggtcacttgcgcgctactacgacaatgcaagctgatcgtcgcgccatctggaacagtcgagacatccggcagggtgacggtaaaggcggtagtcccacccaggccgatggagcaaccgacatcggcaatggtcagttgcgtgctttccgatattcctcgagcgctggagtaattacccagcgcgcgctgtacaaactctggagtagcgaccgaccgactcacgtcaaaacgaggaggtgtagaaaagagtgttggactgcgtaatgcacccagcagttgatcattcgccccttcgtccggcgtcatgcccgccgcctgaactacaccgagaatttcctgggtaacgctattcccccaacttgccggaataagcgagcctggcgtgccggccaatggctcttcatcaacaaaccttccattcaccagccctacactgggcacactctttggataatccaaggtcttgctcctgataataaattctgttggcccacctgcggaccagagccatacagcggccaactgcacgcccaaaaaaacgcccgcttgaagcgggcgtttttattgatgagcgcgatgcagataaatacgctgctgatctatttgaaataaacgcagcactcgatcaatcagctatctgaaaaaaactcactgaccactctggaatcggcggacgggcggtcatttcgggaaagctatcggaggcgggccaatcgcgcagtgcctggcgatactcgagcaactccagatactgtttcgccgtcagcgtcgtgccccgtcccagctcctgttcatcccgatggcgggttaccagccattggctgtccgtcaacacggactggcgccatttgcgcgcctggtccggagcatcctcgtcagtcgccttgccccgtacttcggaagcaaacgccactgctgccgccacgtccaccacgggggaaagcggcgcaacctgttcggcaaggtggatcggcttccccagctcaacctcgacaccctcagggacagcgaccatcgaactgagaaaatccgcggcaaacagctgggaaatcatgaagctgccggtctcgatcaactcgacgacaacgtcgtcttcgactcgtgcatagagggccattattcgtactcccagatttcacaaaaggcattgccgccggtgccactcacatatgaagcagatggattgctcgagcagctgccgctgccgccggaacctcgttgtcccgcattgccattaccattcaccccgttgaaggggccgccgccatcgaatggactggcagccccccatccggaaagcaggccccaattgggattactcatcgcataaccgcccgttgcaccgcgcgcattggccaggttgccacccgttacgacttggccccccataccgccctggacaaatccaggggtgttcgacacgaaggttagaatctgcccccctcctccccctgcggcgctcatgaagctgccaaacgacgctgcgcctcctgcggcccccgcactggttcgagcggccccaccggcgcccaatgtgacgggaacacccgccagcatttccggagtcacgtcgtaaagactctccgcataggcaccagcccctccgccaccgcccaggctttgataagtggccgctaccggcggacaaccggcacctgagcctcccgcaccgaccaggcggacccgaatccgcctggccttggggttggggcgatagactgtgacgccaacggtgtcgaactgcttcaccgccaacagacgcccaccggcatcagtgatgctatatccactcaaggtggttggggtgttcttcagtttggtgaagtcgaccaatgcggcaatcgccagcgccaactgatcgtttttcgcttcctccggcgccaggccggcagccttgatgacattgaggatttcttgcgtcaccccgttgccccaggcagcgggaatcaaggaacccggcgttccgagaagggggttctcatcgacaaaccagccattgaccagcccgacgctggggatactttttggataatccatatcattgccctgcgatctcccttgctcagggagctatgtgcgaaaagccgcccactttgcagtgagcgccatagcatgtttacgaaagacaggctcgacagagacctgatcagtcgccggcaaccttgcgaatcgcctcgatcgctgcctcgcaggcgtctttcgcagcctcctgcttgcccttgctggcctgagcccggatgcgctcttttgcctgcaagcgcagcgtgcgaagtgcgagcagcttgctgttgagctcggccgccttgtcgagaatctggtcggccgcttccctggcggtacggcctttcaccacccaggcccttacagtaaggggcaccgcctttttcgggtagccggcctccttgaaagcctgggcgtcgctggcggcctgggcatactccatggcacgcagagggtcgccgccgagcatctgccgggcggtgtcagcctccgcgtccactcgccggcaaagttgctccgcttcctgttcggcgatggtctcggccttcagggagtccagcgaccactggctaccgtcccagtaatgagcaacggagggtggaggtccatcgacccgagtcagttcgccatccagcacgaaatgcagcgcgtctttctgtttccattgctcggcagtgactggtagcaccttcatggccggagcgggggcggcataggcgaactgttcgaggtcctgccagtcgatgactgttcccgaggtcacgcaataaagaatctgtttgctcatgttttcaccactcgatcagcatgaagcctggtgcaccgttgccacctggctgggcaaggccggcacccgcgatgtaatagccaccagctccgctgcccccagcgccatagccaaaggcgggcttacccgataacccggaagatgtcccagacctagcaatgcccccacctgcgccataaggaccacttgccccagcgccgccgatgccggcgaccgtgttggatgacacatccgtggcatcgcctccggccggaaaccctggccctcccaaagcctccggaacaaaacccggcatattgaccccggaaccagcaccgcccccgccagacagcgacaaaatcgcccccgccgagccgaccagcgtgttaccgccaccggtggcgagagccgccccactggcccccataccggccgccccaataaccacgggaatgacctgccccggcgtcacaacgaccggaaagcgaataaccggttgtccggcaccaccgcccccgccaccggaagcagtcgcgctcgtgcctcccggacacgccccgcccccgcccccacccgcacacccactcagccagatcttcgtcacgccctccggcacggtgaagctgccattggcggtgaagcgctgaatgccgagccccgcgctcttgcggctgatgctgcgaatcgcgctcagcaactgcgtcaggttcgcctcgctgggcgtcaggtcggccgccgtgatcacggccagcagttcctgggtcaccccattgccccaatccgccggaatcagcgaacccggggtgccggtcagcgggttctcatcgacgaacctgccattgaccaacccggcactgggcacactcttcggataatccatcggtctatcccctagtcataattgatatgcacccgcgtatgagccggcgcgctgcggtggatctggcattccagggccgatcccgggttcatgccgaaacgctcgccccagtaactcgcgccaaagcgccggcccaggagtagtcgtccaccggtgttgagcgtccacatgaattgcgcctgccaggtgccgaaatgcgcgtcaccaaaccgtgcgcggcccatgcgcggggcttcgtgctcggtgatggtggcgttcggataaccctggctacgggcgatctcgatgtagtaggcgagcgcctggctgccgacggccagcagtcgccggcgcaccgccaggcggcggtcgtcgaacagcggggtcgggcccaggcaggggtcgggcaggttcatcacccgctcccagtccggtaccagttcgctggcaccggccgggtccatttcgttgagcaggtcggcggcgcgggcatcgagacgggccagttcctgggacacgccttcgagcacctcctcaagttccggcacccgctccgggtcccaggccgggccgctgggcagcaggctgcgcagttggctctggtattgcgcggcggttcttactccagccatacgcaacctccgaacgtcagcaactggttactggcggcgggaacatccgcggccggcgcgctgagccggtgatcgttctcgccggcggcactgctgatggcctcgcggatatggctgatcagcaaggtgtcgcccaggccggcctcgcggttgtgcagatcgcgcaactgggcctcgaccgccgcgcgcaccgcgctggtgtccggcgacagccgcagactgtaggtcacgggcgactgctgcggcgccagcacatgcaactcggccgtcaccggacgcaagggttcgatgtaggtctttacctccgccagttgctcggcattcgggatcggttgcgcatcatcgtcgcgcatcacgaacaggcccacggtgcccggccccaggtagctgccacggcaccacgcccgagtaatccccgggcactccagcgcccaggtctcatagtcctgggccgagccgccgtgggggatgatgcgataggagcggatcacccgggcgcgcagcgattccaggctttccgcggcgacgccgccgctcaggccgggggcgagcacggtgaaggtattgccgatgccctggatcggttgcaccggaatcaggttcaggccggcctcggcattacccagggtgccggcgtcgagggcctggacggtggtgctgttgctgccggcgctggtggtgcgggcggcggtgactttgtaggtgcggccgtcactggcctgcagcagggtatcgacgtccagcaccgcgcctgccgccgccgtgaagctcaccgaaccgctggccgcctgggcggccttgcgcggctggttcaaacgcagcgcggcgatgcgttccagggtcgactcgtctgccttgtccggcaggatctgatcggcgatccagtccaggtagccgtagaggccataggcggcgccaccgagggtacgggccagcacttgcgcatcggactggcgcagcgcatcgctggccaggtcgctttgggtgcgcttgatcagcaccggcagcgaaggggtatcaaagggcataggtcacctgccaactgttatcggggttgatgtccaggcgttcaccgttggccaggaccagcgtcgtgcgcaggttcaggcgctggtcgtcgagacgttcgctgatgatctcgaccgcgctgcaatggccatcgtcgatcagccattgcagggcttcgcgggcatagaactcggcgtcgagctgggtctggcgggtcagcttgacccgccgcagcagccacagccgcgagccgatgcggtcgtcggccacggtgggaaagctgtcgccccaccagccgaagcgctcctcgtcatccagcgggtcgtcgtccgccgcgcgacgccaggtgaacaggctgatcagcacggcacgggtcagtgcgcggtgcaggtcttggctgataaacatcattggcctcccgccggcgcgccggtctgcccgctacccgactgcacgccgccatgcacgtgctggatctggctgatgccgccagcaacctggtcgccctgagagacgatcttgccggtctgggtcagggtcggggtgtcgatatgcaccgcgctgctggcgcggatattgagggtggcggtctcgatgtcgatgatccgcccacgcttgaaatgaatcttgtcgccttcgtcggtgtagatcgccacttcgccgggggccagggccttgaggcgaaaacggcggtcggcgaccaccagcacgatggcatgggagcgatcgccgccgagaaaagtggcgatgccttcggcgccggccagcgggttgctggtgaagccgtagggttcgaagtgctccatgtcgtcgttcacttcgccggcggtcaggcgcatttgcagcgattgcagtttgttggccgagttggcgagcacgacagtgccgcgcgccaacaggcgtgtcagtaggctcatggttttttccttgcccctgtgcaggagcgagcttgctcgcgatagcggccttacaggcacaccgtgtcgcccccatcgcgagcaagctcactcctacactaccggggggttttaggctttcggcggcaccggactggcgtcgaaggtatggggcggcgccacctgcagggtggtgatcgagccctgctcggagagcgagtaggtgaccttggaaatcagcaggtcctggtcgaaacccagcaccggatcgatcacccgcaccagggtgttgtggcgccacagctcgccgttgctctggcgccagccctgcaccttgtaggtgctggtcagggccttgccggtgcgaatggcgctttcccagtcggcccgttgctgggccagctcctgggtcagctgggctggttcgttgatcaccgtgacccgcttgcgcttggccgtggcgtcgctggccacgcccgacacttcgctgaccgcggcgccgcttttctggtcgttgcccttgtgctggccgatcacccggtactcggaaaacacctggctgaagtccatcggcgcgctggccgagaggatgttcttgcccaactccagcacatccaccgcgcgcccgccgctgcccggccgggccaacagcacccggccttcggcgtcgtcggtggagaacacccggaacaacgtcagcaggcggtcgatggactggaacacggtttccccgggcacgatgctgtggctgctcaaccgcgtggtttccgcaatctcgctgaccaccccgacgccgtaggacgcggccagggcctggacgattttcagcaggctctgctcgcgccattggccgggctggttgatcgccgcgcaatccaccaggtcctgggtcagggaactgccctcgatgctcaggccgatctgccgaccgtcatagctgatcggcgccttgaacacatggccgctgagcaacaggtcggcgccgatgcgcacctggcacttggcgccgggacggatgcgctggtccagggtctggcccggccattgccaggtcacgtcgagcttgaaggtgcgaaactgccgctccaggtcggcgctgatttcgacgcttttccagccgccgtaatcctggccgtccaccgtcaacagcacccggttatcgaagttgcccatggctcactcccccgccactttgacgttggtcggcggcaggaagccgggatgggccacgccgttgcgctgctgcacttcggccgcccgggtggcatcgccaaacagccgataggcgagcaccaccgtcggcaggctctgcatcgggttcttcaccaccagccgcacgccggacgaggccaccgcggtgaggtggccgtagaccagctggcgcaggccgttgagcacctcgtagtgcacagcgtcggctttttccgcggcctgccagatcgcctcgttgatcgcgttgcgcagcgccagcacctcatcggccaccggcacttccgcgcgggtcaccggctggatcgcctgcttggccagcgacggcgtgccactcagcttgaccgccggggttgccaccggcagcgaggccacggcctgggcaatccgcaccagcacggcgtcctgcaccaggtcggccatggcttgcgccgcggcggtggtgtccttgccagtggtgagtttcggcgtgtcgatcttcttcaccgcctcgacctgctgcgagacattggccagcacgccgcggtaaccgttgcgcgcatagtccttgaggtccttgatgtcccccagcaagcccttgaactcggcgctcacttccttgggcaggtccttgatcgcccgcaccagcaggttgagatcgcggtaggtgtcgatcagcggcttgagctcctgctcgatggtctggtagacctccttgaggctgttgcgcaggtcggcgatgccgatgcgcgcggccttgaccagggtcatggcctcctcgaagcggcgcaccgccgagccgataaggctgtcggccgacaccagcaacagctggcgggtgttgaccgtggcgctggggaactgcaacggctggtcggggtagaacttcagggtgaaggtcaccaggccgccgtcctggcggctctgggtcatctcgcattcgccgaccttgacctgcaggcgccccagccacgggtgcaccagttcaccgctgccctgctccagcgcctggagcagcttgtcgcgctgctccaggcaatcggcgccgacgatgaacgccgtcaggtcgtgggtccgcgcctgccgccccaggctctcgtagaacggcaggtcacgctgcgggtactcgtgcaactggcccttgtggccgaccggggttttcgcctggtcgacccagaacccgacgccacgaaacgacgccggcaacaaacgatcacgccagctcattggaacctcctagcgaaagtgagcggtagccgacacgcgacgacagcgccacgccgggttggttgatttgcggcgcgctggtacgcaggcccgccggggcattttcgaagctcaccgtcagcccgccctgcaattgcgtgcggttgttggccgcgctctgctgcaacagcgaggtggagctttgcggcaggccggcggaaagcgccgaagaacccggcgccggctggccaccaccgaagaacgccggcgccagagcgcctttgccttcggcattggtttgccgctgcgcctcggtgaggttttccaccttgccggtgacgcgggcgacaaaaccggcgaaaccaccgtcgaacagttccctgatcggtgcgatcaccgcctgcagccgttgccacaggccgctgaaccattcggtgatcggctcccagttcttgatgatctgccccaggggcgaccactcgaacataccgcgcataaactcgatggccggcgccgccagggctttcaacacctcccagagggccgcgaacacatcgctgatgggctgccagttggcaatgatctgccccacgggcgaccactcgaacagggtgacaaaaaagtccttgatgacctgcgccgcgcttttcagggttgcccagatggcgtcgaagtaggtgccgatcgtgccccagttattgatcaccatccccagtggcgaggtatcgaacaacatgacgaagaagtccttcacctgttgcgccggaccttgcagaccggcccagagcgaagagaagtaagcgctgatcgcgccccagttgttgatcaccatccccagcggagagctgtcgaacaagccgatgaagaaggccttgagccgttgcgccggaccttgcaggccggcccagagcgaggcgaagaaaccgctgatcgcgccccagttgttgatcaccatccccaatggcgtccaggcgaacaggcctttgaggaagtccatcgccggaacggacagcgccttgagcaactcccacagcgcagaaaacaggccgctcaggggcgtccagttttcaatcaccagccccagcggcgtccaggaaaacacctgcttgaagaagtcgaccacggacgcggccatcgtcttgagctgttcccagaggccggcaaaaaagccggtgatcgctccccaattggcgatcaccattcccagcggggtccagccgaagaccgtcttcaaccccaccatcagttgcgcggcggcgtccttgatgcttgcccagagggtgacaaaaaacgccgacagcggctcccagttggccacgatcaggcccgccgccaccgcgattcccagggcgatcaggccgatgggcgaggccagcaggccgctgctgaacagggtcacggcggacgaggccagggtcatggcgccgcggatcgcggtgaaggccaaggcgccggcggcgaggccctggaccagctgcgggttgctttcaatgaccttggccacaaagcccagcagcggttgcacggcggtcactaccgagttgaccgccggcagcagcgcgctgccgaacttttgcgagatgtcgtcgacgctgtcgctgaacgccttcaggttagtgcccgtctcgcccagcacatccttgggcggttcgatgccctgcgccaccagcttggcccgcgccgcctggttctcgaattcgatggcggagttgacccccgccacgaaaggcgcggccaggccaccgcccttgatcaggccggaaaaatccagcccgcccaggccgctgtcttcgatgcttttcttgaagcggctgactttcgaacgcacctcgcccagctcggcgtccagtttctgcatgccttgcatgaccaccagcatgttcaccgtggtctgcacgttggtcacgctcaggcgctgtttgatgctcgtctgattcaagctttgattgatgttcaccatcactgcacctgctgcatcgcattgatccgttgcgcgtgctccagggactcccggagcacatccagtggcctggccatcatctgttcggggtcaaccttccagaaccaggccaggtcataggcaaccgcgatcaggtcgctgatggctccgatgccgcactcatgaaaaaactcgcgaccgcccagctcagggcgttgaggtcggccaggtcgagctggttgaccgaggacggaggaatgccggcacagaccgcgatgtacttggccgcgacgtccatgtcgaggctgacttcttcgctcttgtcgatcttgtacggcagcgccttgatcgcccgcacctcctgcaccgtcgggcggcgcagggtcagttcggtcagcggttcgccgtgggcttcgatggccacacgcagctttacgctatcgctcattgccaggtccccttgatgccttcgaacttcagttcgatgctcgcgtcgtcgcctttggaaaccggctcttccaccaggtaggcgccggccaggacgtagaccttgccgttgctgaattcgcaggtgacggtcatgtcggaaccggccaccagctgcttgagcgggaagtccggggtgtgcagcgccgtgaccttgaaggacggggcaatgtcggtttccttgtagaaacccggcacgatggtttcccgtttcacggacatcagcggcgcttcgcagccgccgttgatggtcagttgagcgccgtccactttgacgtagcaggtgcccgcaatcagttgacccatggtgtttctcccaaaaaatgagcccgcaccaggcgggctggaaaagcgcagtgaaagaggctcggcttaggccgccgcgtcgtactgcagacggaattggttgagcagcgcgaacacacgcaggccgttgatgtagtccggcgggaacagcacgttgacccggctcgggtcctggctgtcgcgctcgacgatcaggtgctcggcgaacagctcggcgttctccacgtgaccttccagttcgagcttggcgtactgggcgatcagctcgccgcgaatggtgctcggggtgacgatcggctggccggcaccgaagcgggtaccgtcggcggccagtttgtggcgcccgtacttgctggtgatcacgctttgcaggcggcgcacgataaaggccgactggtgcatggtttcgctgtccaggtaggagttgtcggcctggccgtaggcgttcttctggtaggtggtgatcgaacgctggatgcgcacatagccgccttcgtagtaggcggtggcgatgccgtagctgagcagcgattgacgctcggtcagggtgaaacgctcgctggccggcgccggatcgacacccggcaggctgccgctctgggtcggacggctggcatcggcggagatgaacaccgaagtgcgcgcggccagtgccgcggcctgcacccagaacggctgcggtacgcccggctccagggcctggatggtgatgtgctggtcattgcgtgcttgccctgccgccaccagggtgccgacggtgccgcgcttggcgctgtagacgtgaccgaacagttgcttggcccaggaccagcgaccggtgctgtcgtccatgacggcttgccaggcgttgagggtcgcggtgtcggtccacggcatgcagatgaactcgaaaggttcatcgcccagggccgccagtgcggcaacctgatccggcacgccggcgccgccggccattttgccgaccgtcacgctcaagccagccggggtttcttcgccattgctcttgcccaggcggttgagctgcaggctgatgtcgttagcactgtcgccggtccatttggcggtcagggtcagggtgccttcgaccgcctcggcgctcaccggcaggtcggcggcggcattgattttcagcgccagcgcgctggcggcctgagccgcggtggcggcattgacgatggcggcctgaacccgcacaccaccgacatacaggttgagcacgccgctggcgctggcggtgccggtgaacttcagctcggccttggccacgctgccttcgacgttatgcagcggcaggcaccagatttcaccaatcggatcggtcttgcgccaggtctcgtacatggaggcgagcatcgagccctgaccgccgatgctcttggccagcgcgacgctggacaccagcaccagcttgccggtttcggccggcgcgacgttgtcgttgacctgggccacgatcagtcggcgcatcgccgaagaagcgctattggccgccgaattgtccatctcggcgtagaacagcggcacacgaatgtccgccggaatattgctgaatccgatcgccattatttggctccttgtggtttggccgccttcgcggccttgagggtgatatcgccatcggccagacgccggcgccaccaggcgttgtcgtcgacttcacggccttccagcggcagcaggtcgccggcttcggggtccggcacggcgcggcccgcggccggcagcacagtgatgcgtttgctcattgcgttacgtctccagaaaaggtcagttccaggcgcccgtcgggccccgggtgttgcaggttggggtccgccggatcgatggcatcgacccgcaccgtgaccccggtaaaggacggcaggccgtccagttcacgctcgcgccaggtttccgccggctggctggccagattgcgtcccagctggaactcggcgaaaaagcgcagctgatagaacaaccgcgtggcgctgagcgaaaccagctcgccgccgtcgtattcgatcgggttgtagtccgcgcccggcttgaaccccaccagcgcccgccacaactcggcccgcaggctttcgagttgctccagggcctgccggccgtcgctggcgtccagcaccagggtgatcaccaagcggtcgcggatggcctggcgggtaacgttctgcccggtgctcgggctggccagatcggcgatcggcgtcacatgggcactgggggtgggcaacgcggtattgctttgcagcagcgcgagatcgacgccgacggccacctgattggccaggccggggcagtgatcgcgcagttgcgtgaggatcggagtgatcttcatgaagaagctccagaatcgaatgagataagaaaacctgggggctactcggcagcccttggcggatgcacaaagggcgaacgctcccctcccccacatacgcttgagctttatcaggggctgacagaggagaaggttgcggacggccagagagatcaggccgccgttgagccgggcaaactcagtccggctggggctccaggcatttggccgagagggtgcagcgatagccctgggtgcgggagccgctggaggtcaccttcttgatcgaccagcgtccccgcatgaagccgggccaggtgtcgtcgagcaggaccagcccctcggccgacaacgccgggttgccagggcattcgatctggatattgcgcgcctcacgctcctgcctgcgcatctcgctgacggccgcggccagggctttctgctcgctggcccgacgctggcccaacttgttgaagggtgcggtaccgacctgcaccactcgctccttggcggcggcgctgtcccaccaggtgctttggcaaccctggaatttcgagcggctttcctcatcgaccttggccgagatgaaggccgaatcccccgggcggttatcccgggtcaccgacaagcgcacatccggcagcgtttgtcccgacagggacttgacctgaccgctgcgagccagcacatataggccgttcaccggtttggtcaccgcgccgtactccctggccaggcgcgtcagaaaactcatgtcggtttcgttggactgatcgacatgagcgatctgtaccccatcgagctccggcgctacccgcggcgaaaacccgtggcgggtgaccagttgacgaaacagcgcgccgagggtgatcggcccgtagctggcggatcggcggcgcctgaaacccgtctcgtcgctctccttgaacggcgcggcggtggccaccagcaccaggcgcatggggtacaggaagggtgtgcgccgggcaatgatgaattgccccttgtccaccatgcccgactccaggtaaccgacccgcaagccgatgcggccgcccaggctgggcaacccgtcgagcccttcggtatcgagggtcagggtcagttgatcggattcgatcccggccgcgtcgatgtgctgccattgcaccagacgctcattgagcagcgccgcgttggcgccgtagatctctaccgacggcgtaaatccaagtgccatgtcgcctccttaatcccaggccgatactggcgtagcgagtaccggccgggtttccagctcgggtagtttcacccagagccccgctggcaacaccggcccatgctcggccagccctgggttgagacgccagagtgcttcctcggcggcatcatcgctgcgaccaagctcgcggtagagcaacaggttcaccgaatcgccggcaatgcttctgaccttacgcattgatgaactccgtcagttctatgacccagtcgttgaccatcgccgtgccgtcatcgatcacgtagctttggctctcggacacactgtcgattcgccacaggccccagttgcggccgatgccatcgaccagcggcagcggcacccgcaacgcctgcaaggcacgcaattcatcgagccgcgtcatggcgatcgcacgtatggatttgccactgattgtcagcccttgcaggccctgaccggtctggctggatttaggcttgctggtgagaatttccaggctcacccaaccaccacccgacttgcgcaccagggagctgtaagcgaaccctcgcgactggccgaaaataaaactgcccagcaccatttgctgtcgcatcaaacacctccatcgctcagggcggcaccgcgtcttaccgcgagtggatcggtcatcatcaagggtatgaactgcgccctgagctgttgcagcacgaggtcggcaatatgctgagagctggcttgatcgggcccgctgatctgaatgaccggggcgaaggtgatcggcgggctgactgcctgaccggcacccgccgggttcgccggctggccgcccaccaggtcgttcttgacctgctctggcgagctgaggcgatcgaccagggcgccgagtttatcgcccaggctggcgccgtagtcaccgccataatagccgccgaacagtccaccgacggccgcaccgagagccgttccgatgatgggaacgacactgccgatcgccccgccgagggcagcccctgcggaagcccccgcccagccgccaccggcggttcccaggccagaagcgagcatctgggtatcgccggtcactaggccttcggcgacatccaccgcggcgccgaggtacttcgccggccctggagccctgcggctcaaggaacgaaccgaggcctgcgacccggacagaccgaaagcaaaggacgaacctgcacctggaacagcggccgtggcgttcagcgctttctgagcagactttttggcggccctctttacggccttgcctttggaaccttgttcctgtggaacatctatgctcggaccgctcggggtactcggagcactaggaccactcgaaggacctggagcgccgggccggcgagcacttgcgccatcaaggatgcgtttggcgccgcggttgaacacctcgtctaccactgccttgccctgcttgctgaccaacaacctcagcgccgcgccgagcagcacgaggccggccgtaaccttgggaaaggtttcggccagttcgctgaggccatccaccaactcgccaagaggagtaagcgtactgtcgactaccggtgccaacgcgttgcccgcggcagtggacagtcgctcggtgcgtgcctcgaaggtgtcccaggtggttttctgggtctttgactgcgccagcgccgactcccgtgccgagccgtggtaattcgactcagagggaacatctggatccgagccggctacccgggagaaggtctgcttaacgtcatcgagattctgcgccagacgcagcaccgcctgatcgccctcggcaaacaatgccgtggccagcgtcgaccgcttctcggcgggctgcctgttcagagcctgcagcaccgatgccacagttcccccggcatcctcgcgcaagcccccggccactttcgccgggtccagtcccagcgccttccaggccgcttgctgagtcgccgttgcctgatcgcccttacccagagtcgtggcgatattcttgagcgccccgccggcatcggccttaggcgtatcgctgttgagcaatgccgccgtgagggccgcggcctgcaccggcgccaggccaaccgaggtcgccgcaccaccatgacgctggaggatggctccgatatcagccgcctcggcgtcaccgggggctttacccaggtgattggtcgcatccgccagatccatggcctggccggcgttgagcttcatcgatgtgcgccagccggccatcatctccccggcatccgtgcccgacatcttgaatgccgtcgcggtgattgcggcagcatcggcaaaggccagcaacgccttttgcctggcttcgcccgagccttgatcgctgccgatccccgccttggcggccgtgtattcgatccttaccagatcgaccgccttggttcccccggcggcaatctgtggaagcgcagccattcgctggttttccacggccattgtttcgcgatcgcgcccctggaaatcgaccaggcgccccaggtcggccatcgccgagtccatgctgatcgcaggcttgagcaggtccggcggctcgatgccgccgcctgccttgcccgtacttttttgctggcctgcctcgcccttggcgccaccagcctgggtagccgtaaccgcctgccgcagacgttgcgacgacagcgtcaggttcagggcgtcgaggctagtcaccagcaacccgatatcggcgctgagggtatccagtgcccggtcaagaccgggtagccgatccttgggctgggctgccaatccacccgacggcgcgatgctcgcgacgggcgtgttcaggtcgaccgacctgatgtcaccgaacgtcaaccagccttccttgacggcggtgtacttgagcgaaaacttatcgtccgccatcccgctctactcctgtttcacgccaaggcgagtgatcgcgatgtcgtagcggcgcaatgccttgccggcgtcccactccaggatttccgcttcactcaccgagtaaatgagcggcaccacatcgagtatcacttcgatgtcgcgctccgaaagaaggccgccggtttgtttaaaaaatcgtcgatgcgtacctgcagctgggtccagtcgggcaccgtcagctgggcaagatcgggaatcatcaggccggtgcagtgggcggtgatgaactcggcgcgttccttggccgtcttgagttttttcatcgctttggtcgcccgtagcgccggcatttccacggtcagcgaggtcacgtcctggcctgccacggccagcggcaacagcagttgcacctgatccgggttgtcctcgttgatctcgccctcggcctgtttgaggaagtgggcggtcggacgggtcgacatctcgtgaacgtactgcgcaatgctcacgtaatccggtcgcttgagctgatccagctctttcaccgacaggccggtggccagcttggccagctcgaagaactgatcgtcctcatcgtcgccggcgcgggccagcgcttctttctgcgcggcgtagaacaatggcttgagctgaatctgcgcgatctgcgactcgtcgtcggcggtgatcgggcacagcaggacatggatcggaggcgtccaggacatgaatgaattcctatgtaaaaggtaggagcgagcgggctcgcgacaggagatgaacagcgcttgcgatgcgggctgtcaggccatcatcgcgagccggctcgcgcctacagaggggaagtgtcgcgggttacggcatcagtacggcgcgacgggcatcaccgaggatgtcgacaccattgagcatgaacttctgggtacgcacgtcgatgtcgatcaccggcacgccgttttccaggcggttgtaggtacggcaactgagttccagattggtcttgggcttttcacccattttcagttgcgtctcttccagggacttcaacttgccgccgaccgtgtggtaggtgaagtaagtattgccgtcctggtcctggccggcttcacgcacattcaacagaatgtcgtcgcccacgctcacgccgagggcgagcatgatttccgggcctacgccctggagggtcagcttggcgttaagcgccttaccgcccttggccatttcttcgccgatgaagcgcccgccgcgcatctcttccatgtcgaattcgatcttcggcggggtgaactcttccacggtcgccgacaacggcaggccttgcagggtggccgcgatggcctgtcttacgcggttggtaaacattagagaacatcctccaggaactgctcgatgatttcatcgcgggcgttgagctgatacaccatgtgctcgttcggcgcgtagcggccgtagtcgatgaccacgtaccaggtaccgttcttgtacttctcgacgctgttcagctcggggtgcaggtacacgctgccgcccgggatggtttcgtcggcgaccagggtctgcagccagtcgttgatgcgcttgacctcctggtccatgaaggacttggtcaggttcttggccatggctttctgcccggccttgaccagcttgcggctgatggcgtcttccaggccgacatagctgatgaacttgccggtgatggagcggttacccagcagcgagaagccgccgagcacggtgcgggcgtagtagctgacgccgtagcggttgagcaggtcgccctcggtcgaggtgtcgaggatgttgtattccacggtccgcgatacgtcttcggcgaaggtcacctggttgcccgggctctcccactgcttgaccttggccagcgcggcgatggccaggctcgacggtgccaggaacacgttcttcttcgccgccttggagtacacggccggcatgttgtgcaccaccaggcaacggtcaaaacccaggtccgcgccgcccagttccttgctgtaagtcacctggtcggcgaccgaggcgtccttgccgtcgagcaccacacgggccttgatgcgcttgccgaaggcagcgaactcaccggccaccgccttggtgccggtaaagcccggcgcgccgatgatggtcaggtcttccgggacactgcccagggcagccaggccgagcttgcggccggtggtggcatcgacgccgccgatcacgttgttgacggtgtcggccggggtcgcgccctcttcgacgatcaccacatagaccgggaccttgaccactttgaggatctggtacaccgcctggaacagggtgcccgactcagcgccagtcgggtccagcagagcctgggtggtgaagctgttgatgcgaaacggcgcattgcgcggaatcagcgggtcggccttcggcgcggtgccgaccagaccgatgacgttgtcacccaggccacccatggcctcgggggattcggtggcattgacggtaatgccgttgtgctcgaagttcagaacctcagccatggttattcagccttcttggcagcggcttttttggccgcggtggatggggtggccggttcggccggttggcgcgctgcaaggacgctggtcagttccaggcggccggcggcacgcaaggcactggcctcgacgtcgagcaggtcgagctgttcgtcgaccttcgaccagtggccgccgccggtggggaatggcaccaggacggtgtaggtttggcggttagccatttcagtctctccagatacgaaaaagccccaggtgaatggggctgttgggtgttgctttgcggacaagaaaacgccccgtcggtgcggggcgtttattggagctggtcagctagccaatcgggcgcagaggggcggtgatcgatcaacggaaagtcacccgactcgggccaatcgcgaagagcacgacggaatgactgcaattgtatgtattgctccattgagagggtcgtttgccccccctcctcttgctcgtcacggtgacgaataaccgccgcgtccgttagcaaaagcctctgagaacgccagaagcgttcaagtgctgccgagcgctcgataagatcgacctcaggtgctggcaaaaccacaacacggccatccttgacagaaagtaaatcgcctggctgacgagccatggccgcggtgaaatcttcttcaaaaacatcaataacatcgtctggaatatcatctttccgataaccaaagtcgttaggataaaactgtcccttagttgggctgaatttcatgtcaataactcctaacggccaatagcttgccaacgaatagaagtatcagtagtccagctaccagcagcataaaaaccattattagtttcaccggtggtcactattacaactgacggacagcctgcactattgtgagtggccacaacaccgaacaactcatttggaaaagggatagggaaggcgttataagtacttttcacaattgagttgccgaacgcgcaatgatttgcgtgaccgcccgcgccaccatccccccacatacgaattaagccattcggcatacgttcatagccattccgcgcaactaaggctttaccaaccccaccaaccactcgatatgaaaaacccggttcgccaaccgaagcactggacatgacaatgaactcgcaggcgctgccgttcctcaggacatatgaagatgacaccatctgcgctgcaggccctgcaaacctcgagtttggcgccgttagcgaaacgtcccctccgacagcctcaaggtagaagctcgttcctaagggaagcgtgtttgcgtcggggagcgcgtacgcctgtgcagccccgcggttaaatccaatgtattttccggcatcagacaccgggaccgttccgcttgccgcctgatagtcgatgtagccactgcgactgccctgagccaaccgaacgaattcggttgtggcaagcaacttggagttattaaagcgcggaggagtcgggccggtagggctccccacaaatgccggcgaaagcagacgtgcgaaacccgctgtcacatcctgaaaagcgagcgcggtagtgcccagtacaatctgaccatcagtaatcagttgccagatcgtatcagcctgcgtcgccccctcttctaccgaaatcgtcaggttcggggttatcttggcgttgttatccgcatcttttgcacgagtccatagttcattggcaacgacatagatgccgttgtccttagccagggtctgattcttgacaagcacccgatcaccagccagcaccgcgacaccatcaatcatctgcgcagcgcttaagacgatattccctgtggtcgacgccctcactgactgcttcgcgtcgagcttggccaattcatcggcgacataacccgccacccaagcccgcgtcgccttgaccaccgtatcgtcgatcagcagcgtcaccagcgacgcattactggtctcgaaaatcgagcggatatagaactctttccccgacccggaagtcgccagcaccggcttgaacgactccggatacttgatgatggcgtaaaggattccagtatcggtccacagcccggcctcgcgtacataccagccgccgacctcgggcgggatggtcacttcggccagcagccagctggggtttttctcgtcctggaacagcgcgttcaacgggccgcgccagacttcgcgcttgagggcagtgtcggtcgccgccgggttgtagaccgcgccaccgccgtcaccgacggaaatctgcgacagcttgatcggtacgcctgccgccttgcaggcagtttcgtaggcgatccccgcattggtaagcagggtgtaatagtcggccatttaggacccctgaggataaatagtggatgtttcgacgctgtacagcccggcggccatgaaggcctggcccgaggcttcgagcccctcgacgacgatcggatagagggtggtcaactcgccgcagacggtcgccgccgcgatggagtgggaaccgaatgcgctcaggcccacggatatcgccaagatgtcgcgttcacttttggcatccgccaggcgccgatcgaggcgcgcgtcgatctcttcgctgtaaggccgctcggtgaaggccctgaccgaaaagctgtaaggcgcccccgctggggtctgctcataccaggcgcgaatctcgggtatcaattgcaaacccttggcggcattttccagcgccttgcgtgtaccggcctggcgcgcggtgggccaggccagttcgaccgtcaagcgtttttcggcctcgggcgcttcagagcgccactcaccgacaccccgatcagccgcaagataaggcaagaactccaccggcgtttcggcggggctcatcagctccggaaacggcggcgcgacacgttcgagcaagcgggcaaaaccgaggtcgagcgctcgttccaaaggcgagctgttgaccggcaggagacttgggtgagcggcttcgtccttcatagcgtgagcacctcaacctcgacatccgtgcagtacggcgcctggaaggccgtcgtgacgatcggcgccaagggttcgagaatctccaactgcaccgcacccgcggcatgcagcgtgtaatcgatccagctcggatccacccgcccttccaggcgatggcagctgtcggcgtaagcctgtagttgccgctgcgtggcaacctgggtcagtccggaatcggggcccgggttgatcttggccaccacgcgaatcttgtagggtttgatctgtgccgcctgcaccgtcacccgatccgtttccggcttcacgtccggtcgcgcaaagtgtcggcgtacgccttcgagcaggtcctcggacggcgtgccgtcgccttcccgcgagagcaccgtgacctggacttcgcccggcgcggtacggcgcccgttgccatccttgacctgagcggcgaaaccgtccgggtcgaaggtgtaggtgacggtcaccacgcccgcctcggtggagtccaccttcaccgtcggccgctcgccgagggtgaagacttcgcggcggtactgcatgcgcgaaccggcggccggcgcatggggcgccaggtaatagcgcagacgagcgtcttggtcgctttcatagaccgcggggaccggcggaaaggccgccggatcgcccgggtcgagcaactgccgctccaggcccatgtccgccaggcgtgcatcgagattgctgccggtggcccaccaggccagcatctgcttgatgcgggcgttgtacttgcgctcatgggtttgcaggcgcaggcagaaggcttccagcgccagggtcagcagctcgctttcgttggccaggctggcctggagtttctgcgcattggcgggggaacgctgggccacgtaatcgacgacgaaggtcttgaactcggcgagcagtggctcgaattcttcgacggtgacaatggccggctcggccaactggtgttcaccgggtatcagcatgctcatgtcacgacctcgaacgtctgttggcggtttttccaggtgccggcgaaacgcaacagcaacccggcgccgcgccggctggcgactatgacctgcggctcgaaatcgccgatgccgttctgctcgttatagaacgcctgcgccgcatggctctgggcgaggatcagcaagtcatcgccgaggttctggcccagcaggtcgggaatcagcgagccgtacaacgggcgcttctgccgcgtgcccagcggcgtggtcagggcgcgggtcgcgcgctgcacgaactgcagccagtcatcgaccccggcgccggtgtttctatcgactccaatcatgggaagcctcttaatcaagggctgataacgcggccctggtgttccaccagggggccgctgaagtggatgccggcgctgtcgagcaagataccgaccgcgcccagccgcagctcgatcgcctcaggccgcatcgccagccgggcgggaccgatgctcaactcgaccgcctcgcgggaggcgatgagcgcggtcgggccattgctccagctcaagacatggccggcatcgtcataactgctttgggtgccatcggcgtattggcggcgggtcagcgcggccagggtcgacgccggtggaaagcggtcgcagttgaggccgaacagcgccaccgactgcgcgccgccgtcgccgccaccgtagttgaacagcaggcactgctcgcccacggagggaatgcgcgattcgctttgcgcgccggcgctggggttgaagaagcggatcgccggggtcagcagctctccgtggctgacccggcaggtgttgctggccgcatcgaccgcctggcacacgccgatacggcagtggttttccgcccgccggtgcaagtcatcgagttcggtttccatctccgccaggcgctcgatgatcgggcccagctgcatgcgcagcagctcgtcaaacatggctcagccctccagtgcttggtattggtcggggtcgtcgatgttcgagacttcccaggtgcgggcgaacttcggtataccggtcgggtcgtccagcaagggctgcccgaggtacagcgtctgggtgaacgacagcgtccaggccgcgtgctgctgctcaccgcgaatcagggtcgagggcaggccctcgaggttcatcggcaagtcgcactgcgctgccggcaggccccagcggttatccgtggccaggtccttcagcgcacaggccagatcgcaggcctcgaacccggaccgctcggcccccacagccgccacggcttgcagcgagactgtcaggacatgggcgatacgcccttcctgactgcgcatgcccggggcatcgcgctcgatcgccatcagcacccaggcctgctcgagcagaccatcgaagtcctggtgactgccaaccttgaggccaatgcccgcccctcgcagggtctcggcaatggcgaaaaacagctgcgacggcttgtcgatgactgcgggcatagagaggcctcctgttcagatatcaggggttgaagttgcgcaggagcgctgtggatgtcgcgcgagatagaggaacagcgaatgccggtttgggcaggattcttgatcgccaggtcggcgagcgacgtcaggaacggaatgggtgatgcaacggatggctcacgagacttcgctgaggtccggcatcaccttcgatggagccccctgccctgcgagcggttcgccttgatcgaatcaggcgtacttctcgttcagcgcataaagaatcgcgcaggtttccacgtccagtttcccggtgtagttcttcggcctgaagtgcatctggaacgcccgcaccagcgactggaagaagtcatccgttgcctgggcctgcacgccatagccgtaggtggcgaaagccttgagcacttcggcacgcgcgggcagcccggcagcgcggaattgctggacgtatttcctcttggtcggctcgtcgtaccaggcgccaatgccggctttgtagagctctttccagggcagcttggggcccggatcggatttgcggcccaccgcgatatcggagtggcccaccacgtttttcggcgacatgtccggataacgctggagaatattcagggccagctgcttgagcgcctcgacctgggagcgttcgtaatccgggaaggtgaagacgccattgacgtcagtggcctcgttgacgatctcgatgccgatggaagtgtcgttcaagccgctgcgaccggcccagtcactgactccggcatgccaggcgcgatcttcttcggccaccaggttgaaaattcgttgttcctggaagcccgcggcctgatacgtcgggtcctgcagcgccgggatcaggtaatgggcactcgccgcgccagtggtcagcgccttgaccgatgcctcgaagttcagcgccgtgtaatgcagcaccaggaaacgcacccgcttgttgtagggcgcgagggtgcggtagctgttgtagtcgattgggatcatggtttgcctctctttgaaacgaatgggtgtacgacgctgggccgtatctggcacctcccggcagggagggttgattgagtgccgttcaatacgagtacgcatcctgcgtcaggcgggtagatatccacgtggataaggcggcagggtcgacttaatgaatgaacgaatgcttgcggcggttgttcaggcgtccgagcggggatccttgggcggcacctcacacacaccgagccgcttggccgcccagcgctcgtagagcccgatggccacatcggcgcccgccatggcggtcaggcaaccgaaggcgccggcggtccagatcgatacgccggcggcgtacagcagcatgatggtcgagaccccacaaatcacgcaggccccggagcgcagggccaggcgccgcagcagcaaccagccgcgggcgccctccttgtcggcgcgccacatttcgccggacaccccacccaccagggcaaggacgatgacaagccagatgggcatgtccagcaacgcttgttgctcgtttgtcatgtcactcctcctgagtggaaaaggccaatgggctggcccggtaatcaattggcttgtgtatcaacggtgcatatcccggcatggcccacggtaggtaggcattccaaaaagcccggtcacccgggcttttcagtaatgcggtccagtttcaaggggacctgatcgttcggcgctactggcgcggtacggatccattcaaattgttcctccgaccgcggtccctgcccgccggataactgttcacggtgctttacgctgcacacccgggtcagttgccaaccctctgaaccgtcgaggccggctcatcgctgcctttgcttttgccactaaagagcggagttgctcgccgctgtcgggcggcttggaacgaataatatgcatgtatgcatatacagtcaatgcacaaatgcatttatttatgcacgacaaatgcgcctgcgcatgaacaccgcataaataaaggcgtgaagggttttccacaggcacaaaaaagcccgctcgatggcgggctttggcgttatgggctgcggttaacgggcgtacatgccccaccagaagacgtgaccgaggatgacgatctgctcttcctgcatttcctggaagctgtagtcctcatccggatgttcgtcgcggttgaagctacgcaggcgaatgccggaaggcaggcgatagagctgcttcacccgcagctgaccgttgtggttgatggcatacaggtcgccgtcgatgatgtcgccgataccgcacttgccggcattgacccccaccgtggcgccatcgcgcagcaccggcagcatgctgttgccgcggaccgtcacgcatttggcctggtcgaactgcacgccattgtgccgcaggctgcgcttgccgaagcgcaggctggagcgctcgctttcctcgatgacgaatcttcctgatcccgcagccaattcaacctcgcgaagaaaggggaccgacacctcgtcgtcatcgacgggggtatcgtcgtcccacagacttatgtccttgagttccgaatgcggatcggccgaccgggcaggagcgacagccgcgcgcccgcgcagttgatcggtgctcaccaggaagtattcggcgatccgcgagatgtgtttgtccgaaggatcgacaatcttgccgctgaggatccgcgaaagggtggattgaggcacgccggtacgccgatggagttccgtgggggaaatgccatcgcgatcgagcagctctcttaagacggtagaaacgttgcgcttttgcataatgcgcatattgcgggttattttcgccgacggcaaatgctaaaatgcatattaatgcataaaaacccgaaatcccgctgggttcatccctgcgaaggtcggaccgcccatggtaaccttgcgcccatcgcgaaaaagccgggcccatgccctctgcttttgcccaccctttcaacgaatcaacctgacgacccgatgaataaagcgctcaccgatctgtcctcccacacgccgatgatgcagcagtactggcgcctcaagaaccagcaccccgaccagctgatgttctatcgcatgggcgacttctacgaaatcttctatgaagacgcgaagaaggccgccaagttgctggacatcaccctgaccgcgcgcgggcagtcggctggccaggcgattccgatgtgcgggattccttatcacgccgccgaaggttacctggccaagttggtgaagctcggcgagtcggtggtgatctgtgaacaggtcggcgacccggccaccagcaagggcccggtggatcgccaggtggtgcggatcatcaccccggggaccgtcagcgacgaggccctgctcgatgagcgccgagataacctgatcgcggcggtgctgggcgacgagcgtctgttcggccttgcggtgctggacatcaccagcggcaatttcacggtcctggaaatcaagggctgggaaaacctgctggccgagctggaacgcatcaacccggtggaactgctgatcccggacgactggccacaaggcctgccggcggaaaaacgccgtggcgtgcgccgtcgcgcgccctgggacttcgaacgcgactcggcccacaagagcctgtgccagcagttctccacccaggacctcaagggtttcggctgcgagaacctgaccctggccatcggcgccgccggttgcctgctgagctatgccaaggaaacccagcgcaccgccctgccccacctgcgcagcctgcgtcacgagcgcctggacgacactgtggtgcttgacggcgccagccggcgcaacctggagctggacaccaacctcgccggcggccgcgacaacaccctgcaatcggtggtcgaccgttgccagaccgccatgggcagccgcctgctgacccgctggctgaaccgcccgctgcgtgacttgaaagtcctgcaggcgcggcagacctcgatcggttgcctgctggacggttaccgtttcgaaaggctgcaaccgcagctcaaggaaatcggcgacatcgagcggatcctcgcccgtatcggcctgcgcaacgcccgcccccgcgacctggcgcgcctgcgcgacgccctggcggcgctgccggaactgcaaatggcaatgaccgagcttgaggccgagcacctgagccaactggccgtgaccaccagcacctatccggaactggccgcgctgctggagaaagccatcatcgacaacccgccggcggtgatccgcgatggcggcgtgctgaagaccggttacgacgccgagctggacgagctgcaatcgctgagcgaaaacgccggccagttcctcatcgacctggaagcccgggaaaaggcccgtaccggcctggccaacctgaaagtcggctacaaccggattcacggctacttcatcgaattgccaagcaaacaggcggaacaggccccggcggactacatccggcgccagaccctcaagggcgccgaacgcttcatcactccggaactcaaggccttcgaggataaggcgctatccgccaagagccgcgccctggcccgcgagaagatgctctacgaagccttgctggagaccctgatcggtcacctgccgccgctgcaggacaccgcgggggcactggctgagctggacgtgctgagcaacctggccgagcgagcgctgaatctcgacctcaattgcccgcgcttcgtcagcgagccatgcatgcgcatcacccagggtcgccacccggtggtcgagcaggtcctgaccacgccgttcgtggccaacgacctgagcctggacgatcagacccggatgctggtaatcaccggtccgaacatgggtggtaaatccacttatatgcggcaaaccgcgctgatcgtgctgctggcccatatcggcagcttcgtgccggcagcgagctgcgagctgtccctggtggaccggatctttacccggatcggctccagcgatgacctggccggcggtcgttccaccttcatggtggaaatgagcgaaaccgccaacatcctgcataactccaccgagcgcagcctggtgttgatggacgaagtgggtcgcggcaccagtaccttcgatggtctgtccctggcctgggctgcggcagaacgtctcgcccagctgcgggcgtacaccctgttcgccacccactacttcgagctcaccgtcctgccggaaaacgaacctctggtcgccaacgtgcacctcaatgccaccgagcacaacgaacgcatcgtgttcctgcaccatgtgctgccaggccctgccagccagagctatggcctggccgtggcccagctggcgggggttccgagcgatgtgatcgtccgcgcccgcgagcacctgagtcgcctggagaccaccagcctgccccatgaagcgccgtctccggtagcgggcaagccttcggtcccgcagcaaagcgacatgttcgccagcctgccgcacccggtcctcgatgacctggccaagctcgatctggacgacatgaccccgcgcaaggcactggaaatgctctatacattgaagacacgcatctaacgctgatgctttcaagctgttagaatctcgcgcggtttgggatgctgcggactattagcctggtccgcagactatcgctcccgaacctggcgaccccgtcctgaaggggctccgctgccgccgcctgaggagagaattagaaatgaccttcgtcgtcaccgacaactgcatcaagtgcaagtacaccgactgcgtagaagtctgtccggtggactgcttttacgaaggcccgaacttcctggtgattcacccggatgagtgcattgattgcgcgctgtgcgagcctgaatgccccgctgtagcgatcttctccgaggacgaagttccagaagagatgcaggaattcattcagttgaacgttgagctggccgagatctggcccaacatcactgaaaagaaagattccctgcccgatgccgaagagtgggatggcgtcaaaggcaagatcaaagatctcgaacgctgattacctcgcgttccccaaaaaggcccgttgcgggcctttttgctgttccggattcacttttacgcaggcaaaaaaaaggttcttcacggaatcccgggaaacacagaaacaagaacgccgatttgattgatgatgttcgtgcgagcaaacacatctaacaaaccggcgttcttatgcgtgatattaatactttccttcccttttgggagggcttttctgtcgtcacgatcaagcctgatggtgacgcgctccagatcgatctgattccccacgccacccgattcccttcctgtggcggctgccaaaaactctgttcaaccacgcatgagtactgccagcgagtcatccgcgatctgcccattcttggccgagcagtgcgcctcagcgttttgcttcggcgtgtcggctgtcgggactgtggcaaacgcatggaggccgtcagttggctggatcgctatgcccgcatgacgcgccgcctggccgatgcggtcattcaggcctgcgagcgccttcccacgctacacgtggcccaactgttcgggttgcattgggacagcgttcgcttgctgggaacgtcgcgccttgcaagcggcattgagtgttttgccaaaggcgcagccacagcgcttggtcatggacgaatttgccctgttcaaaggtcatcgttacgccagcgtagtgctggacgccgatacccggcgagtgctgtggattggcgaaggccgcagccgggcggcagtcagaccctttttcgaagagctggggtcagagggttgcgctcgcatcgaagcggtggcgatggacatgaacactgcctttgacctggaggttcgtcagcactgcccaaaagcgcgcgtggtctacgacctcttccatgtggtggccaagtatggtcgagaggtgattgatcgagtccgcgtcgatgaagcgaatcggctacgtcacgacaagcctgcccgcacggtcatcaagcaggcgcgatggctgttgctgcgcaatcggcagaacctgaaaacgccggaacaacaagtccgcctggaggatctgctggcggccaaccaagcgttgatgacggtctatttgatgaaggctgaactcaaaacgctttggacaccgagcaccgcctggggctggcgatcagcctggcgacaatggctgcgccatgcgcatgaaagcgacataccgcctctgatccagtttgccaaacgactgaagggttactggcggggcatcgtcagccgggtgcgctggccaatgcatacgggccagttggaaggcatcaacaatcgaatcaaggtcatcaagcggatggcgtacggttaccgggacagcgaattctttttcatgaagatcaagagcgtctttcccggtaatccgtgaagaaccaaaaaaaggggcggtatgacccgcccaccttttttccctagtccctgtgttccttttcatcgtcctgatgaatcgcatcctgcgatgtcctgaccatcatccttgatggctgtgtctatccgtcgacacagagctgatattagagagtttccatgacagagcaatggcactgacaggtagaaaacgtgtcgaacaccgccccaatcattaaaataagtttttattaatcagtaagataactaaaaacctcagatcaaacagacaactttcataccgcataaaaaccgaacacttacgaaagagtcagcctttacttacatgctcgttcagctattgaacatgcgcctgcatatttcatctgactcctatcgattacccaataaaaagccccgaacgtgtcggggcttttcacggcaggactgctcgtgccgttactggaacagggactcgctggagaggccgttcttctcgaggatctcacgcagacgcttgagaccttcgacctggatctgacgtacccgctctcgggtaagcccgatctccaggcccacatcttccagggtgctgctctcgtggccgcgcaagccgaagcggcgaaccaccacttcacgctgcttgtcggtcaattcggaaagccactgatcgatgctttgcgacaggtcgtcatcctgcagcagctcgcacggatcggtaggacgatcgtcggtgagggtgtccagcagggttttatccgaatccggacccagcgagacgtcgactgaagaaacccgctcgttcaagcccagcatgcgcttgacctcacctaccggtttctccagcaggttggcgatttcttcaggggagggttcatggtcgagtttctgtgtcagctcccgtgctgcccgcaggtagacgttgagctctttgaccacatgaatcggcagccggatagtccgggtctggttcatgattgcccgttcgatggtttgacggatccaccaggtggcataggtcgagaagcggaaaccgcgctccggatcgaacttctccaccgcccggatcagaccgaggttgccctcttcgatcaggtccagcagcgaaagcccacgattgacataacgccgggcgattttcaccaccagacgcaggttgctttcaatcatgcgcttgcgcccggccggatcgccactttgcgacagacgcgcaaaatgaacttcttcttccggagagagcaatggggaaaagccgatttcattgagatacagctgcgtcgcgtcaagcgctcgcgtgtaatcaatgtacttgtgttgtttcaatgaagcggagtgtttggatttggcacgaactgaaggtacagcagatccctcattcgacatcgaatcagtggcgatatccgtctccataaggagaacttcatcgtcgatgtcaaactccggcacttctttactgagagccattgttatagtcctttggtgagttcgacctcaggctcaagcgacgcctttatccttggcaacgctggaacctgttccctctacgtgacggaacaggcttggtaacggatcaacgacgtggcaggaattgcagcggatctacaggtttaccttgtcggcgaatctcaaagtgcagtttcacccggtctgtaccagttgatcccatttcggcaattgtctgtccaactttgacctgctgcccctcccgaaccaacagcctacggctgtggccgtaagcactgacgtaggtatcgctgtgtttgatgatgaccagttcgccgtagccccttaagccactcccggcgtaaaccaccgtcccatcagacgcagctaaaacaggctgtcccaaatccccggcgatatcaatgcctttattcaaactaccgtttgaagagaattttccaatcagaataccgttcgcaggccagccccagccctttggcgcggggcctgcaggcggtaatggagccggcgcgggctggctcgcaatcgttggcgcggcccctgctggacgacgaattaccgtggttttacttgaagaagatgcactggaagccgactttgtaaccacggctgtcggggccgaacccgagcgtccgtcgaagcggatggtctgccccgggtgaatggtgtacggctcggcaatattgttgcgcgcggccagggccttgtagtcccagccataacggaaggcgatggagaacagggtgtcgccgcgacgaaccgtgtattgccccgtggtcaccgtcgggcgctgcggtaccgcgctggtgcgatcgacgacccgggcgctgctcgacttattgctcgaacagccgaccaacagagaactcaagacaaggccaatcaccagtcgctgaaagcttgttgtacccatacgctgcgcaatgactgtgagactcacccgccgctccctttgtggtggttgaagataaatagtgcctggctcaggcatgaaatgtcgcaagtataaccggccgcccacgctttattcccggcaaagcgaaatcggcaggcaccagcctatcgatcagggttcaaggttacttaaccgattgatcaagctgtaagaccaagccgatcaaacagaattcacccgctccaaacaaatgctcaggccaatggcccgttgagcaagggaacgaagcgaaccgagccgagaacctgccgtgaaaacccctgctcctcacgaatgaccagcatcagttgctgcacttcgccggcaccgactggaatcaccatccggccaccgggcgccaattggtccagcagggcctgggggatgtcggtggcgaccgccgtcacgataatcccgttgtacggcgccagcgccggccagccttcccagccatcgccccagcggaataccacgttgcgcaggttcagctcgaccagacgctccttggcccgatcctgcaacaccttgatgcgctcgaccgagaacacccgctccaccaattgcgacaataccgccgtctggtaacccgacccggtgccgatctccagcaccttgtccaacgggccagccgccagcagcaactcgctcatgcgcgccaccatataaggctgcgagatcgtctggttgtgcccgatcggcagggccgtgtcttcataggcgcgatgcgccagggcctcgtcgacgaacagatgccgcggtgtacgccgaatgacttccagtacctgggcgttggacaggccttcatcgtaaagacgctggatcaggcgttcgcgggtacgctgggaagtcatcccgataccgcgacgcaacaaatcgtcctgctcgcgagccatcagcgcagcccctccagccagccatcaagacttctgaaagcatcattgaaggtgcgatcgagctgcaacggcgtgatcgacacatagccctgcatgatggcgtggaagtccgtacccgggccgccgtcctcggcgtcccccgccgcggcgatccaataaccggccttgccgcgcgggtcgaccgtcttcatcggcgccgccgcacgggcgcgatggcccaggcgagtcaactgaatgccacgaatgtgatcgatgggcagattgggaatgttcacgttcagcacggtacgtggtggcagatccagctgcccgtgggcctcgaccagtttgcgggcgaaataggcagccgtcggcaggttatccacctgacgcgagacgaacgaaaaggcaaacgccggcaggttcaggaaacgcccttccagggctgcggcgacagtgccggaatacagcacgtcgtcacccaggttagccccgaggttgattccggacacgaccatgtccggatcgcgctccagcagtccgttgaggcccaggtgcacgcaatcggtgggagtgccattgatactgatgaaaccgttactcaaggtgtgcgggtgcaacggccggtccagcgtcagcgagctgctggcgccgcttttgtcctggtccggggcgatcaccacgcactcggcgtaatccgccagcgcagcatgaagcgcggcgagaccgggtgctgttacaccatcgtcgttagaaatcagaatacgcatgggctgtccgtctgccccaccggcaccagatcgacgagttcacgcaccaatacggtggcgaagcatccggccggcaggacgaattccagttgcagaatgtcaggctcgggataatgccacgtcaacccgccaatgggcagccgcaggatgcgacgttcgtggctcattccggctttaatcaaccaatcgcgcagatccgcttcgtcggcggccacctgctgctccagcagttgggtcgccccggcggtaggcgattcgccttcgccccactgcgggccggtcgggtgcaagtcgaggatggccaggcgcggatcgctgcattcggcttcgccggccgggaaaaaactgcggctgtcggtgaaggccagcaggtcgccgacctgtgcccgctgccagctgccatcggccacgcgcgccgccagcacccggttgaacagatagctgcgcgcggtggaaagcagccgcgaacgtacattgcgctgctccggcaaggccttgcgggcggcccaatcgcgggcatcgaccaggttaccgccgttatggccaaaacgctgggcgccgaaataattggggatgccgtgtttggcgatcgattgcaggcgttcttcgatccccgccttgtctgccttcaattcggtcaggcgcagggtaaagccgttggccgcatgggcgccgcgttgcagcttgcgcttgtggcgggtcagcttgaggatcttcagcgtgtcgttttcagccgccgacagatcgggatccgccttgccgggcaactgcacactgaaccactgccgggtcagcgcctggcgatccttcaagccggcataactgacggtgcgcaacggcacacccgcggccttggcaatccgccgtgccgcttcttcggtgttcaagccgcgcttttccacccataaccacaggtgttcgccttcgccggtcaggggaatgtccaggacttcgtcgacctggaagtcttcggcggtggccttcagtaccgcgctacccagggcttcgccataggcccgcgggcccaacagttgcagttcgttcatgcgcgcagcaacaaggcaacggaatgcacggcgatgccttcttcgcgcccgacgaagccgagcttttcggtggtggtggccttgacgttcacttgatccaactcgacttgcagatccgcggcaatcagcgcgcgcatcgtttcaatatgaggggccatcttcggcgcctgggccacgatggtgttatcgacgttgccgaccttccagcccttggcatggatcagtgcgacgacatgacgcaacagcgcacggctgtcggcgcccttgaactgcggatcggtgtccgggaaatgtttgccgatgtcacccagtgcggcagcacccagcaaggcatcgctcagagcatgcaacagcacgtcgccgtcggagtgggcgagcagcccgaagctgtgtgcaatacgcacgccgcccagagtgatgaaatcgccttcagcgaaacggtgcacatcgtagccgtggccaatacgcataaaaaaacgccctgattgagtcagggcgtgattctacctgctttggcggacattagccgctcagagcgcgcgcatgatgctgcaagtggtcgccgatgaagctggcgatgaagaaatagctgtggtcgtagccgggttgcagacgcaacgtcagcggatgaccggcggctttcgccgcctgttgcagcacttcgggcttgagctgattggccaggaaatcgtcacgatcgccctggtccaccagcaacggcagcttttcgctggcttcctggattagcacactggcatcccattcgcgccaacgggagcgctcttcgcccaggtaacgggaaaaggctttctgcccccatgggcaatccatcgggttgctgatcggtgcgaaggccgacaccgactggtagcgccccggattgcgcaacgcgcagaccagagcaccgtggccgcccatggagtgcccgctgatgccgcgcttgtccgaggccgggaaatgcgcctcgaccaatgccggcagctcctgcactacatagtcatgcatgcggtaatgctcggcccagggctgctgggtggcattcagatagaatccggcccccaggccgaagtcccaggcgccatccgggtcgcccggcacgccagggccgcgcgggctggtatccggcgcgacaatgatcaaccccagctcggcggccagacgctgggcaccggccttttgcataaagttctcgtcggtgcaggtcaggccggacaaccagtacagcaccggcagcttgccgccctgctctgcctgcggcggcaggtacacggcgaacaccatgtcgcagcccagcacctcggaatgatgcttgtagcgtttgtgccagccgccgaagcttttctggcaggacaggttttccagactcatgggcatttcagccgcaggcttcaagcttcaagctgcaagttggcggtgatcgctcttgcagcttccggcttgcagcttgccactgctccttagaaatgaatgacggtacggatgctcttgccttcatgcatcaggtcgaaggccttgttgatgtcctccagccccatggtgtgggtgatgaaggtatccaacgggatttcgccgctctgggccatttccacatagcttggcaactcggagcggccacgcacgccaccgaacgccgaaccgcgccagacgcgtccggtaaccagctggaacggacgggtggagatttcctggccggcaccggccacgccgatgatcaccgactcgccccagcccttgtggcagcattccaatgcggcacgcatcagctgcacgttgccgatgcactcgaaggagaagtccacgccgccgtcggtcatgtcgacgataacctcctggatcggccggtcgaagtctttcgggttcacgcaatcggtggcgcccagctgtttggcgatctcgaacttggccgggttgatgtcgatggcgatgatccggccagccttggctttcacggcgccgatcaccgccgacaggccgatgccgcccaggccgaagatcgccacggtgtcgccagccttgaccttggcggtattgatcaccgcgccgatcccggtggtgacgccgcaacccagcaggcagactttttccagaggcgcttctttagggatcttggccaccgagatttccggcaacacggtgtactcggaaaaggtcgaggtgcccatgtagtggaaaatcggctggcctttataggagaaacgggtggtgccgtccggcatcaggcccttgccctgggtggcgcggatcgcctggcacaggttggtcttgcccgacaggcagaatttgcacttgccgcattccggggtgtacagcgggatcacgtgatcgcccacggccaccgaggtcacgccctcgccaatggcctcgaccacggcgccgccttcgtgaccgaggatcgacgggaagataccttccggatcggccccggacagcgtgtaggcgtcggtgtggcacacgccggaagcgacgacccgcaacaacacctcgccagccttgggcatggcgacatcgacttcaacgatctcaaggggtttcttggcctcgaaggcaacggcagcgcgtgacttgatcatcctgggtctccagcgaataaaaacgagacagggagtgtaaaacagcgcctgacgatgaataatccggacaaaagcaaaacattattgctgtacagggataatcaccatgaacgagaaccgctgggaaggcatcgacgaattcgtcgccgtggccgagtgcagccagttcactgccgccgcggagcgcctcggggtgtcgtcttcccatatcagccggcagatcgtccgcctggaagaacggctgcagacccgcctgctgtatcgaagtacccgccgagtgaccctgaccgaggccgggcagaccttcttgcagcattgccagcgcctgcaggacgggcgcgaagaggcattgcgcgccgtcggcgacctgaccagcgaacctaagggcatgctgcgcatgacctgcgcagtagcttacggcgagcgttttatcgtgccgctggtcaccagtttcatgggcctttatccgcaactgcgggtggatatcgaactgagcaaccggcccctggacctggtgcacgaaggcctggacctggccattcgcctcggtcgcctgcaggactcacgactggtggcgacccgcctggcgccacgccgcatgtacctctgcgcctcgccgtcctacctggaacgctacggccgcccccacagcctgtcggagttgagtcggcacaactgcctgatcggcagctcggacatctggcagctggagcaggacggccgcgagttctcccagcgggtgcaaggcaactggcgctgcaacagcgggcaggccgtgctggatgcagcgctacagggggttggcctctgccagctaccggattattacgtgctggaacatttgcatcagggcagcctgatttccctgctcgaggcgcatcagccgccgaataccgcggtgtgggcgctgtatccgcaacaacggcatctgtcgcccaaggtgcgcaagctggtggactatctcaaggaggggttggccaaacggccggagtataaggattgatccgtagccgctgccgcaggctgcgatcggctacgcaatacccgtcatagcggacaacgcggtcgatcggcttgaagtacatgacgactacaaaaaacgcgtcccgttccgggccgttcgcagcctgcggcagcggctacaggggcccgcgaaaagctacgctcagtggcgattggcccaacgctggcgcagccactccaggtcttccggacgggtcaccttgaggttgtccgaacgcccttcgatcaggcgtggcgcctggccggcccattccatcgccgacgcttcatcggtaatcgccacatccgccaccaggctgtcggccagggcgcgatgcaaggcgccaagacggaacatctgcggcgtataggcttgccagatcaggctgcggtccacggtttcctgcactcgtccgtgcttgtcgatccgcttcagggtgtcacgagccggcaccgcgagcaggccgcccacaggatcatccgccagttcgctcagcagcttgtccaggtcatcacgggacaggttcggccgtgcggcatcgtgaaccaacacccagtcttcatccgcagcgccctgggcatgcagatggagcaaggcattgaggaccgatccggaacgctccgcgccaccttcgacccgctggatccgcgggtcgtgggcacaggccagggtcggccagtaaggatcgtcaagcgccaggctgaccaccaaccccttcaggcaaggatggtcgaggaaacagccgaggctgtgttcgagaatagtgcgcccgcccagttgcaagtattgcttgggacggtccgcggccatacgggcaccgacgcccgcggcaggaatcacggcccagaaggccggcagcgactggatcattgggccaactggtagagggtttcaccctccttgaccatgcccagttcatgacgagcccgctcttccacggtctccatgcctttcttcaattccatgacttccgcgtcgagtacacgattgcgctccagcaggcgctcgttttcagcgcgctgatcggcaatttgctgagtcaggtcggttacctgcgccaagctgccattccccacccagaggcggtactgcaggccagccagcagcaagagcaagacgaggaacaaccaattgggactgcgcatcgaatatcgggtatccagtgaaaaaagacagccatgccaacaacttcgaacctactgacagcacgaagcctggaagaaccaggcttgtgctcttaaggcatcagattagtggcaaaaatctcgttgatgcgatttttctgacccaatccggtgtctttgtaccatctaccgcttaaccgcgaaactcgctgcggccgttgtacttggctttgccattcaattgctcttcgatacgcagcaattggttgtacttggacacgcggtcggaacggcacagcgaaccggtcttgatctggccagccgaggtgcccacggccaggtcggcaatggtcgagtcttcggtttcaccggaacggtgcgaaatcactgcggtgtaaccggcagccttggccatctggatggcttccagggtttcggtcagggtgccgatctggttgaacttgatcaggatcgagttggcgatcttcttgtcgatgccttctttcaggatcttggtgttggtcacgaacaggtcgtcgcccaccagttgggtcttctcgccgatcttgtcggtgaggatcttccagccagcccagtcggactcgtccagaccgtcttcgatggagatgatcgggtaacgctcggtcaggcccttgaggtagtcggcgaaaccttcagcggtgaacacctggccttcgccggacaggttgtacttgccgtcttcgaaaaactcgctggccgcgcagtccagcgccagggtcacgtcggtgcccagcttgtaaccggcgttggccacggcttcggagatcactttcagcgcgtcttcgttggaagccaggttcggcgcgaaaccaccttcgtcacccacggcagtgctcaggccacgggccttcagcacagctttgaggtgatggaaaatctcggtgcccatgcgcaggccttcggagaaggacttggcgccaaccggctgcaccatgaattcctggatgtcgacgttgttatcggcgtgctcgccaccgttgatgatgttcatcatcggcaccggcatcgagtagacacccggagtaccgttcaggttggcgatgtgcgcgtacagcggcaggtcctggtcctgtgctgctgccttggccgcggccagggaaacggcgaggatcgcgttggcgcccagggttgccttgttgtcggtaccgtccagcttgatcatcgcctgatcgagggctttctggtcgcttgggtctttacccagcagcaggtcgcggatcggaccattgatgttggctacggccttcagtacgcccttgcccaggtaacggctcttgtcgccatcacgcagctccagcgcttcacgcgagccggtggaggcaccggacggcgcgcaggcgctgccgatgatgccgttatcgagaagcacgtccgcttcgacggtgggattgccacgggagtcgagaacttcacgacctttgatgtcgacgatttttgccattgttgtaaacactccaaagttgacgaaaacgacgcagctgaagggaatatctttaccgtcggcaagcagggaacagggggcagacttgcggacgataaggctcaggcccgcgggcctgagcgattaatcgtgcggtactttaccggagaaatcgggtttacgcggtctctaccgtcggaaaactcttaaccagttcgtccagggccttgagctgggccaggaaaggttcgagcttgtccaggcgcagggcgcatggaccgtcgcatttggcgttgtccgggtccgggtgggcttccaggaacaggccggccagggactggctcatgccggccttggccaggtcggtgacctgggcacggcggccgccagccgagtcggcacgaccgccgggcatttgcagcgcgtgggtcacatcgaagaacaccgggtattcgaactgcttcatgatgccgaagccgagcatgtcgaccaccaggttgttgtagccgaagctcgaaccacgctcgcagaggatcaactgatcgttacccgcttcctcgcatttgctcaggatgtgtttcatttcctggggcgcgaggaactgggctttcttgatgttgatcaccgcaccggtcttggccatcgcgaccaccaggtcggtctggcgcgacaggaaggccggcagctgaatgatgtcgcagacctcggcgacgaccgcggcctggtagggctcgtggacgtcggtgatgatcggcacgccgaaggcttgcttgatgtcctggaagatgcgcatgccctcttccaggccaggaccacgataggaggtcacagaagaccggttggccttgtcgaaactggccttgaacacgtaagggataccgagcttctcggtgaccttcacgtactcttcgcagacctgcatggccatgtcacggctttccagcacgttcatgccgccgaacagcaccatgggtttgtcgttggcaatctcgatgtcgccgacgcggatgatcttctgtgccatcggggttacgccttcttctggtgttgagccaaagccgccttgacgaagccactgaacagcggatggccgtcacgtggggtcgaggtgaactcagggtggaactggcaggcgacgaaccatggatgatcctgcgcctcgaccacttcaaccagcgcgccatcgccggaacgaccggaaattttcagaccggcgtcgatcagctgcggcagcaggttgttgttcacttcgtagcgatgacggtgacgctcgacgatcacgtccttggcgtagcaatcgtgcaccttggagccagcttcgagcaggcattcctgagcgccgagacgcatggtgccgcccaggtcggaggcctcggtacgggtttcgacggcaccggtggcatctgcccactcggtgatcaggccgacgaccgggtgaccactggcgcgatcgaactcggtggagttggcgtctttccagcccatgacgttacgagcgaactcgatcacggccacttgcatgcccaagcagatacccagatacggcactttgttttcgcgagcgtactggacggcggtgatcttgccttccacgccacgcagaccgaagccgcctggaaccaggatcgcatcgacaccttcgagcagcgcggtgccctggttctcgatgtcttcggaatcgatatagcgcaggttgaccttggtacgattggtgatgccggcgtgactcatcgcttcgatcagcgacttgtaggcgtccagcagctccatgtacttgccgaccatggcgatggtgacttcgtgctcggggttgagcttggcgtcgaccaccttttcccactcggacagatcggcaccgttgcattgcaggccgaaacgctcgacgacgaaatcgtccagaccctgcgcgtgcagcacggccgggatcttgtagatggtgtcgacgtcttccagggagatcaccgcgcgctcttcaacgttggtgaacagcgcgatcttgcgacgcgaggacacatccaccggatggtcggagcggcagatcagcacgtcaggctgcaggccgatggaacgcagctctttcaccgagtgctgggttggcttggtcttggtctcgccagcggtagcgatgtacggaaccagggtcaggtgcatcagcatcgcgcgcttggaaccgacttcgacacgcagctggcggatggcctcgaggaacggttgcgactcgatgtcacccacggtgccgccgatctccaccagggccacgtcggcatcgccggcgcccttgatgatgcgacgcttgatctcgtcggtgatgtgcggaatcacctggatggtggcgcccaggtagtcaccccggcgctctttgcgcagcacgtgctcgtagacacgaccggtggtgaagttgttgttctgggtcatggtcgtgcggatgaaccgctcgtagtggcccaggtccaggtcggtctcggcgccgtcgtgggtgacgaacacttcaccgtgctggaacgggctcatggtgcccgggtcaacgttgatgtacgggtccagcttgagcatggtgaccttaagtccccgcgcctccaggatggccgccaatgaagccgaggcaatgcctttccccaatgaagaaacaacaccgcccgtgacgaatatgtagcgcgtcatgaaaaaccctagaagtctgcgttaaagcggtccgagccgccggggaaagcgaaggaaggccgaagcccccgatcacctgcattaatcacagtgcacctttcaaaaaaaccgccgcgttgggacagaccggaagagaaaacaccggtacgttgctcgctacacattttttggaatcgcccagcaaagactgcttggtaatcggcaactcctgcaattcaggcgaatccacagaagttgtatcaagaagggagcgtagtctaccggaaagggactttcagctcaaaccttgatcgctcgaaggcggctgccaatgcaattgccaaccttcatgggcatttgcgtcaagacctggcaggttcgccaccgcgagcaattcttcgcctcgatacagcagcggcaatctgccacggacgaaggccggcagacctgcctcattgagcagacgcttgaggtcgcggtggccgcgtcccggcagttgcatcacctcgcccccctgacggtaacgcacttgcaaaggcccttgcggcgcgctaccgatgaattgcaaccgaccattacccggcaacggcagaggcgcagcggtatcgacccaactcggtgcagacagttcgggccgcagccagctatccgacaaccaccagacgcgccctgccgcccgctgcacctcgccctgccccagccgccataccgggcggctgtcgcccgcggcatcccgcagcgtctgccagcccgcccagtgatcgctgtccggcagcagcgtgaagcggctcagccagtgactcagggcattgcgctggcgtgcctgcgacaagccgagcaaaggcgccagcgccagggacggtaatcccagccactcgaactcggcgcccttggccgcctcttgcagatcggtaatggccagctcatccagcaactcccgcgcctcgcgcaaatgcgccgcgctgcgcgccatgctgctggcagcttgtggccagcgggcggtcagcaatgggaatacctgatggcgcaggtaattgcgggagaactgccggtcctggttggaggggtcgtcgatccagtgcaactggtgatccagagcgtaacgctccagttcgtcgcgggagacgtcgagcaaaggccgcagcaaatgccccggccccaacgcacgcgacgccggcatggccgacagccccctgattccggctccgcgcagcagacggaacaacagggtttccgcctgatcgtcgcggtgttgggccgtcagcagcaactcattgctgccggttactgcctcgaatgcggcataacgcgcttcccgcgccgcgcgctcgagactggctcctggttgcacctgcaccgccactacctgcaacggcacagccaaagcctcgcactgggcccggcaatgctccggccaggcgtcagccgcagcctggaggccgtgatgcacgtgtatggcggtcaaagggggaagcctgtgtcgttgcttgagttgggcaagcaggtgcagcaggacggtggaatcgaggccaccagagaatgcgatgcgccaggccgatcgatccagccagggcaggaggcgttgcagcagtttttgcgtgagggctgtatcgaatgggctcatgaatggagcggatcctgagtagagaccgagcgtgctcgcaatgcctgaaaagcctcgacctgaatggccgaggcgcccatttcgcgagcaagcccgcccctacaaggagcgtcgatctatcagagaccgtagctcatcaggcgatcgtaacgacgcgccagcagggtgtcgttatccatcttcttgagcatcgccagctgggaagtcagctcggcgcggatcagcgcggcagcggcaaccggatcacgatgcgcgccacccagtggctcgccaatgaccttgtcgacaatgccaaggcctttcaggcgctcggcggtgatgcccatggcttcggcggcatccggtgctttctcggcggttttccacaggatcgaggcgcaaccttccggcgaaattaccgcgtaagtggagtactgcagcatattcagctgatcgcagacaccaatggccagcgcaccgccagaaccaccttcaccgatcacagtggcgatgatcggggttttcaggcgcgccatgacccgcaggttccaggcaatggcctcgctctggttgcgctcttcggcgtcgatgcccgggtaggcgcccggggtgtcgatgaaggtcaggatcggcatcttgaagcgctcggccatctccatcaggcggcaggccttgcgatagccttcagggcgcggcataccgaagttgcggcggaccttctcgcgcacttcacggcctttctggtgaccgatgatcatgaccggctgatcgtccaggcgggcaacaccgccgacaatcgcggcgtcgtcggagaagtgacgatcgccatgcagttcgtcgaactcggtgaagatgtgctcgatgtagtccagggtgtacggacgacgcggatgacgcgccaggcgtgcgatctgccagctggtcagcttgccgaagatgtcctcggtcagggtgctgctcttgtcttgcaggcgggagatctcatcgccgatattcagcgaattgtcattaccgaccaagcgcaactcttcgatcttggcttgcaggtcggcgatcggctgttcgaaatcaagaaaattcgggttcataggcgtccgtcttgggtcgacgtccaagagagcttgggccggccggttgtctattcgcgccctaccttaagggagaggcgcgttcaggtcgagattaaaaattcgggtcgagatcggcgcacttttatggcgccagaccgtcaacggtattggaggaagacgttgtctcgcccgaactggtcacgcagggcttgaatcaaggcatccgccggatcgatccgccaggcttcgccgaactgcagcaaggccttggcgtcctccttggtgtattccatggagatcgggcaagcgccgcgatggcgtttgcacaactcccccagccagcgtagctgatcgcccttgagggcttcggtgtgcaccttcaggcgcaggctttccgccaggttggtacgcgcatcttccatgctcatcacccgcttgacccgcaggcgcaggccgccggagaagtcgtcgttgctgacttcgccctcgaccaccaccattgcgtcggtctgcagcagggactgggccgaatggaaagcctcggcgaacagcgaagcctcgatccgccccgaacgatcgtcaagggtaatgaaccccatcttgtcgccctttttgttcttcatgacccgcagggcaatgatcatgcccgcgacggtctgggtatcgcgcgccggcttcaggtcgacgatgcgctggcgggcaaaacggcggatctcaccttcgtattcgtcgatcgggtgcccggtcaggtacaggccgagggtatctttctcccctttcaggcgctccttgagggtcagttccttggccttgcgatgattggcgtagacatccgcatcttcttcgacgaagaccccgccgaacaggtcggcgtggccactgtcggcggtacgcgcggtctgctcggccgccttgaccgcttcctccagggccgacaacagcaccgcgcggttgcggtcgatgttggcctgataagccttgatttcgtcgtggaagtaaggccccaggcggtccagggcaccactgcggatcaatgcatcgagggtacgtttgttgatgcgcttgaggtcgacccggctgcagaagtcgaacaggtccttgaacgggccaccttcggcacgggcctcgacgatcgcctccaccggcccctcgcccacgcccttgatcgctcccaggccatagacgatgcggccgtcgttattaacggtgaacttgaagtcggaactgttcacatccggagcatcgaggcgcagcttcatactgcgcacttcttcgatcagcaccaccaccttgtcggtgttgtgcatatccgcggacagtaccgcggccatgaaaggcgccgggtgatgcgtcttgagccatgcagtctggtaggacaccaggccgtaggcggccgagtgggacttgttgaaaccgtagccggcgaacttttccaccaggtcgaagatgttgcccgccaggtcggcatcgataccgttgttggcgcaaccttcgatgaagccgccgcgttgcttggccatctcctcgggttttttcttacccatggcacgacgcagcatgtcggccccgccaagggtatagcccgccatcacctgggcaatctgcatcacctgttcctgatacaggatgatgccgtaggtcggcgccagtaccggccgcaggccctcgtactggtagtccggatgcggataggccagttcggcgcgaccgtgcttacggttgatgaagtcgtccaccatgcccgattgcaacggaccaggacggaacagcgctaccagtgcgatcaggtcttccagacagtcgggcttgagctttttgatcagctctttcatgcctcgggattcgagctggaacaccgcagtggtctcggccttctgcaacagctcgtaagtcttcttgtcgtccagcgggatgaagtcgatgttgacgtcgggcaggttctttttgacctgctcgcggttgatggtctccatcgcccacttgatgatggtcagggtccgcaggccgaggaagtcgaacttcaccaggccggcggcctcgacgtcgtccttgtcgaactgggttaccaggccgtcgccggcttcgtcgcagtagatcggcgagaagtcagtcagcttggtcggggcgataaccacgccaccggcgtgcttgccgacgttacgcaccacgccctcgagcttgcgcgccatctcccagatttccgccgcttcttcatcgaccttgatgaagtcacgcaggatttcttcctgctcgtaggctttttccagggtcatgccgacttcgaagggaatcatcttcgacaaacggtcagccaggccgtaagacttgccctgcacccgcgccacgtcacgcaccaccgccttcgcggccatggaaccgaaggtgatgatctggcttacggcgttacggccatacttctcggccacgtagtcgataacccggtcacgaccgtccatgcagaagtcgacgtcgaagtcgggcatggagacccgttccgggttgaggaaacgttcgaacagcaggtcgtaggccagcgggtcgaggtcggtgatcttctgcacgtaggccaccagggagccggcacccgacccccggccaggacctaccggcacgccgttgctcttggcccactggataaagtccataacgatcaggaagtaaccggggaaccccatctggatgatgatatccagctcgaaattcagccggtcgacatacacctggcgcttggcttcatagtcttcggtggtgtccttgggcagcagcacgctgaggcgctcttccagcccgtcgaacgacaccttgcggaaatactcgtcgatggtcatgccatcgggaatcggatagtcaggcaagaagtgcttgcccagcttcacttcgatattgcagcgcttggcgatctcgaccgtgttttccagggcctcgggcaggtcgctgaacagctcggccatttcctcggcgcttttcaggtactgctggtcgctgtagtttttcgagcgacgcgggtcgtcgagggcacggccttcaccgatgcagacccgggtttcatgggcctcgaagtcttcgcgcttgatgaaccgtacatcgttggtcgccaccagcggcgcgccgatcttgtctgccagggccaccgcagcgtgcaactgctcttcgtcgttgggacggttggtacgctgcacttccagatagaaacgatccgggaataccgccatccactcgcgagccagggtttccgcttcttgcaggtcgccagagagcaaggcgataccgatctcgccctctttcgcggccgagagcatgatcaggccttcggcggcctcggccacccactcgcgctcgatgatgatctggccattgcgctggccatcgataaagccgcgggaaatcagctcggtcaggttgcgatagcccacggcattcatcaccagcaggctgatgcggctcagcggattctcgggatccttgttcgacaaccacaggtcggcgccacagatcggcttgatcccggtgcccatggccgccttgtagaacttgaccagggaacacatgttgttctggtcggtaaccgccaccgcgggcatgcccatgccggccaacgtcttgaccagcggtttgatccgcaccagaccgtcaaccagggaatattcagtgtgcaggcgtagatgaacgaatgaagccggcatagtgatcctgtaatgagcgcaaaaacaacaaggcccggattgtaccgggccttcgctaaaacatcagcctcaggactgaatctcgcccacgttctcacgggcttcgtaggcttggcgtaccggcgcgaacgaacgccggtgaatcggtgttggccccaggcgggccagcgcttccagatgaacgggcgtcgggtagcccttgtgcccgccaatgccataacctgggtagatcagctcgaacgccgccatctcgcgatcccggctgaccttggccagaatcgacgccgcggcaatcgccggcaccttgctatcaccctggaccacggcttcggcaggcatcggcagtttcggacaacgattaccatcgatcattgccagtttcggggtcacgctcagcccttctaccgcgcgctgcatggccagcatggtggcatgcaggatattcaactcgtcgatttcctcgacttcggcgcgggcaatgcaccagctcagggctttttcacaaatatcgtcataaagcttttcgcgacgggcctcggtgagcttcttagaatcgttcaggccgagaatcggccggctcggatcgaggatgaccgcagccgtgaccaccgcgccgcacaacgggccgcgccctacttcgtcgacaccggccaccaagtcttcagcatcggctaccagcgagaaatccagtcccatctgcatcttttcgttactcatgccggtttgccaatcaggttcaacaccgcttcagccgcctggttggaggcatccctgcgcaaggtacgatggatctcgtcaaaaccgcgggtctgctcctggccgtcttcgatcaagggcgacagggtctgggccagggcctctgcagtcgcgtcatcctgcagcaactcgggaaccagcaggcgctgggccagcaggttcggcagggaaatataagggctcttgaccatacgcttgagaatccagaaggtcagcggcgccaggcgataggcgacgaccatcgggcgcttgtacagcagcgcctcaagggtcgcggtgccggaagcgatcaataccgcatcgcaagccgccagcgcctgatgcgactggccgttgagcagggtcagcggcaggtcgcgaccggccagcagttcttccagctgagtacgccgctcaggactcgcgcagggcatgacgaaacgcacccctggacgcaaagcgcgcaggcgttgtgccgcgtcgaggaacaaggccccgaggcgcccgacttcgccgccacggctgcccggcatcagggccaccagcggaccaccgggcaggcccagctcagcgcgagccgctgcccgatcggcctccagcggaatggcgtcagccagggaatgtccgacaaaccgcaccggcacgcccttttcttcatagaacttggcttcgaacgggaacagcgtcagcatcaggtcgcaaccttcgcggatcttcagcacgcgcttttgccgccaggcccagaccgaaggactgacgtagtgcacggtcttgataccggcctggcgcaattggagttcgatgttcaggttgaaatcgggggcgtcgataccgatgaacacgtccggcttttcggcgatcagggtctgaaccagcttcttgcgccgggccagcagttcgcgcaagcgtcccaggacctccaccaggcccatgactgccaggcgctccatcgggaaataggaaaccagcccttgggcctgcatcagcgggcctccgacaccgatgaattcaacggcgggatgctgggccttgagcgcgcgcatcaaaccggcgccaagaatgtcgccggaagcttcgccagccaccagcgcaatacgcagtctgctcatgattaacgggtgatgccgcgggtcgaagactggatcgagtcacgaaataccgcgacttcgggaaattgtgcagcagcttctgccaactcgacgagcgcctgatcgacggtcaagccttggcgatacaccactttataggctcgacgcagggcgtgaatcgcgtcttcgctgaaaccacgacgacgcatgccctcgaagttcatgctgcgcgcctcggccgggttgccgaacactgtgacaaaggccggaacatccttgccgatcgccgtacccatgccggaaaagctgtgggcaccgatatggcagtactggtgaaccagggtgaaaccggacaggatcgcccagtcgtccacatgcacatggccggccaacgccgtgttgttgaccaggatgcaatggttgccgatcacgctgtcgtgaccgatatgggcgtacgccatgaccaggttgtgatcgccgagagtagtctcggaacgatcctggacagtgccgcgatgaatggtcacgccttcacgaatgacgttgtggtcaccaatcaccaggcgggtttcctcgcctttgtacttcagatcgggagtgtcttcgcctaccgaggagaactggtagatacgattgtgcttaccgatccaggtcgggcctttgagcactacatgcggcccgatcaccgtaccctcgccgatttccacaccggcgccaacgatcgaccacgggccaacctcaacgtcgtcggccagaatggccgtcggatcgatgattgcgcgagggtcaatcaaactcatagtttgcgttccgcacagatgatttcagcggagcagactggcttgccgtcgaccgaagcctggcattcgaatttccagatctggcgcttgcagctgatgaacttggcttccaggatcaactggtcacccggcagtaccggctggcgaaagcgcagcttgtcggaaccgacgaagtagtagagggtgccatcggccggcttcacgtccagcatcttgaaaccaagaatgcccgcagcctgagccatggcttcgatgatcagcacgcccggcatgattggatgcgcggggaagtgaccattgaagaaaggttcgttgatgctgacattcttgtaggcacgaatgcacttgccctcaacatccaggtccactacccggtccaccaacaggaacgggtaacggtgaggcaggtattcgcgaatctcgttgatgtccatcatttcggggggaagcctgtagtaaagattgggagcgtgcggctaacgcacactcctctagcaaatcaaggaggcagtctaacggctgtgcacacttgatatggaaatggtatcagccatctgatgaagctttaccgtcgggggtcacttccccaacgcgcttttccagttgtcgcaggcgtcgcgcgagatcatcgagctgacggatgcgtgccgcgcttttgcgccactcggcagcaggctgcatggctgtaccggaagagtaggcacccggctcggtaatcgagtgggtcaccatggtcatcccggtcaggaaaacgttgtcgcaaatatcgatgtgaccaaccagcccgacaccgccggcgagcatgcagtgcttaccgatccgggtgctgccggaaataccgacacaggctgccatggcggtgtgatcaccgacctggacgttgtgggcgatctgaatctggttatccagcttcacgccattaccaatgacggtatcggccagcgctccgcgatcgatagcagtattcacaccgatctcgacatcatcgccaatggtgacaccgccaatctgcgcgatcttctgccagatgcccttctcgttggcgaaaccgaaaccttcgccgcccagtaccgcaccagactgaatgaccacacgcttgccgatacgcacatcgtgataaagcgtcacgcgtggagccagccaaccgccctcgccgatctggcaacgagcaccgataaaacaatgagcaccgatcgtgacgcccgcggcgatttgcgcgccgctctcgacgaccgcaaacgcgccaacactggcagccgcgtcgaccacagcatcctcggcaatgaccgcagtcggatgaataccggccggcgccttgggcttgggatcgaacaggtgggaaatccgcgcgtacgacaggtagggatcggccacgaccagggcatcaccggcataaccttcggcatccgccgccttcagcagcacggcacccgcctggctatcagtcagatacttacggtattggggatttgccaaaaagctcaactgagctgggccagcctcctgcaaggtggctagcccagtgatttctttctctgcggagccacgcagggtggctccgaggaactcggccagctggccgagctttatagtcactgtcatgggttacttcagctgattcatgcgctcgataacctggcgagtgatgtcgtactgaggtttgacatcaatcactgcgccacgctcgaacaccaggtcaaaaccacctttcttgatgacttcttccacggcgctatcgagtttcggcttcagttgcttgagcatttcacgatcggcaacggccttggcttcgttcagttccttggactggaactggaagtcacgggctttctgcttgaattcgagttccagacgctcacgctcgccttgctgcatcttgtcgccaccggcaaccagacgatcctgaatgcccttggcactgctttccagggttttcagcttgttcaactgcgggccgaacttcttctcggcgtccactgcgtatttcttcgcagcatcggattccagcagtgccatctgatagttcagcacggcgattttcatgtcggcgaaggccggacctgctaccaggacagtcgccaggagaaccaattgagtcaacttacgcacgatgcactcctacaaaatccattgtcgttatcttgggtcggactcttagaaagtctgaccgagggagaattggaacacctgggtttcagcgtcgtcaggtttcttgatcggcatcgccagagcaaagcttagcgggcccagagcggttacccatgtcacgccgacacccacggaactggccagattgctcaggctgatgtcgttacactgtgtattggacggcgtgccgttggtgttggtggtcttctcgcacttggagtcgaatacgttacccacatcccagaacacggaagtccgcagcgaacgctgatccttgacgaacggcatcgggaacaacacctcgacaccaccctggatcagcacgttgccaccgaatggcagggcatcctggtccgggtcaagcgaggtaccggcgttgcctgtcgcacccacaccacgactcggagtactgcgaggacccaaggtactgtccttgaaaccacggaccgagttgaaaccaccagcatagtagttttcatagaacggcaagccgtcggtcgaaccataaccgtcgccataacccagctcggtgtgcaggcgcatggtgtaggtatcggtcagcggctggaacaactggccacggtagtcgagtttgaagaacgacaggtcgctacctggagtagtggcttccagcaccaggctttgggaatgaccacgggtcgccaggacacctttgttcagggtcgactcggaccagcctgccgaagccttgaagttcaggtagttgtcgccttcgcggttcacgaagtcgaagatttcgtcgacggtataacgaccggttttgatcttgtcttgctgcgcggtcaggccgaaggtcagacgcgaagtctcgctgatcgggtagccaacgctgacgccggcacccaggctgtctaccgcatagctcgccacgtcgacatcgaggtcgtcgtagtcagtggtgcgatagaacgcgttgtaacccaggctcacaccatcggcagtccagtaggggtcgacatagccgaagttgtaacggctttggtattcgctgcgagtcaggccgatgctgaccttgttaccggtacccaggaagttgttctgggtgatcgaaccaccgaggatcagaccggcgctctgggcgaaaccgacgctggcggtgatcgaaccggaagcctgctcttctactgcgtagttgacgtctacctggtcgtcgacacctggcacggccggggtttcgacgttgacttccttgaagaagcccagacgctccagacgggtcttggactggtcgatcaggtaagtcgaagcccagccaccttccatctgacgcatttctcgacgcagcacttcgtcctcggacttggtgttgccgcggaagttgatgcggttcacgtaggcacgcttgccgggatcgaccacgaaagtgatatcgaccgtgtgatcttcgtcgtgaggctgcggaacaccgttgacgttggcgaaggtataaccctcgttgcccaggcggcgggtgatcagctcggaagtggtggtcatcagtttgcgcgagaacacctggcccttctcgaccagcagcagcgatttgacctggtcttcaggcactttcaggtcaccgctgagcttcacgtcacgaacgctgtacttctcgccttcgttgacgttcacagtgatgtagacgtgtttcttgtccggagtgatcgaaacctgagtcgaggctatatccatattgatatagccacggtccagatagtaggaacgcaggcgttccaggtcaccggacagcttctcacgcgcatacttgtcgtcgttcttgaagaacgacagccagttggtggttttcagttcgaacagatcaaccaggtcttcgtccgggaatacagtgttgcccacgacgttgatgtgctggatggcagctacggtgccttcgttgatattgaccttcaacgccacacggttgcgcggctgcgggaccacttcggtatcgacggtggccgagtagcggccctgagcgacatattggcgctgcagttcgttacgaacaccttcaagggtcgcacgctggaagatttcgccttccgcgagaccggattgcttgaggcctttcatcaggtcttcagtggaaatcgccttgttgccttcgatttcgatactggcgacggatggacgctcgactaccgtgatgaccaggacattgccatcgcggcccagctggatatcttgaaagaagccggttttgaacagcgcacgagtggattccacgaggcgacgatcgtccgcctgctcaccgacgttcagcggcaaggccccaaagacgctacccgcggagacccgctggaggccattgacgcggatatcggagatagtgaaggactcggcgtgaacttcggcgatcatcaatacggagagaaccgcagttagcagcagacgtttcatgaagtcctttcttattccaactggcaataaagaaactgccgcaaaatgcggcagattcgcaattcagcgaagcgttacagacgacccagatcgttgaccagggcaagcaacatcaccccgaccaccaagctgataccgatctgtatcccccaaccttgcacccgatccgacaagggacgaccacgcgcccactcgatcagataaaacaacagatgccccccatccagtacaggaatgggcagcaagttcagaacccctaggctaatactcagataagcaaggaaattcaagaaatcagcaacgcccgactgggcagaagcgcccgccactttagcaatggttatcggtccactcaagttttttaccgagagctcgccgaacaacattttcttcagtgaatcgagggtcaacacgctcatggtccaagtacgccgggcaccctcgccaatggcggccagtggaccataactgacctcgcgaagcatttccggcggccaatcgaccgccttcacgccagcccccagataaccactggcgaccttctctttaccgcgtgcggccagggtcaccaggacgtcgatttgagcaccatcacgctcgacgtgcagcacaattttggtatcaggacgtacacgcacccagtcgacgacctgctgccaatcggtcagcgcctgaccatccagcgccagcaagcgatcgccggttttcaagccagccgcctgggccgggcctttcggatcgagttcggccagaacgggggcgagcgccggacgccaggggcgaatccccagggaacgaataggatcaggttcatcggtacccttgagccagttgtcgagcaccagctcgcgcggcgaatcggcggtcgaaccttgctcacgcaccagcaactgcaaggtaccgctttcacccaaccgtcgaatcagttgcaggttgaccgccgaccagcccacggtgggctcgccatcgatggcaacaatttcctggccagagctcaggccagccttggcggcaatgcttccagactcgacactgccgacgaccggacgcacctgctcggtaccgagcatcgccagcccccagaagaacaccagtgccagcaggaagttggcgacaggaccggcggcaacgatggcgatacgctggcgtaccgacttgcgattgaacgattgaccgagctggtcgacgggcacttcgccttcgcgctcgtcgagcatcttcacgtagccacccagcggaatggcggcaatcacgaattcggtaccttgccggtcataccaacgcagcagcggcatgccgaagcccacggagaaacgcagaaccttgacgccgcaacgacgcgccacccagaagtgaccgaattcatggaaggtgaccagcacacccagggcgatcagggtgccgacaatcatatagagcgcgctcatctactttctccgcaatcctatccagtaccgatacgctcgggcttgtcgcaacttaccggctgttgcgacccagccactgctcagccagggcacgggctttggcgtccgccgcgaacacggcgctcagctcatcgactgcgacaaccggttcaaggcttaaaacttcttcgatgatactcgcgatctcggggtagcggatgcgccgttcgagaaacgcggcaacagctacctcgttggcggcattcaacatggccggagcgctgttgccagcctctgcggcctggcgcgccaggcgcaagcatgggaaccgctcttcatcaggcgcctggaaatccaggcgcgccacggcgaacagatccagcggaggcacacccgagtcgatccgctccggccaggccagggcattggcgatcggcgtgcgcatatccgggttacccaactgggccagcaccgaaccgtccacatagtcgacgagcgagtgaatcacgctttgtggatggatcaccacctcgacctgggcaggcttggcatcgaacagccagcacgcctcgatcagctcgaggcctttattcatcatgctggccgaatcgacggaaatcttgcgccccatggaccagttggggtgggcacacgcctgctcgggcgttacctgctccagatcggccagcggcgtttgccggaacgggccaccggatgcagtcagcaaaatgcgccgcaccccgacattgctcaacccacgggaaaagtccgcaggcatgcactggaagatggcgttgtgctcactgtcgatgggcagcaataccgaaccgctcttgcccaccgcctgcatgaacagcgcgccggacatgaccagcgcttctttattggccaggagaattttcttgccagcctcgacggcagccagggtcggacgcaagcccgcggcaccgacgatagccgccatgaccgcgtcgacttcagggtcggacgccacttcacacaacccctcctcgcccaccagtacacgggtgcgcgaaccggcattgcgcaagtcttcctgcaagctgcgcgcggcagcgatatgcgggacgacggcaaaacggggagcgtgacggatgcacagcgccagcaactcagccagacgactgaaaccgctcaaggcgaagacctgataacgctcgggatgacgggcaatgacatccagcgtactgaggccgatagagccggtggctccgagaaccgtaatctgctgtgggcgactcacaatgcagccatccacaacagcacggcgaataccggaatggccgcggtcaggctgtcgatacgatcgagcaccccaccatgccccggcagcaagttactgctgtccttgatcccggcctggcgcttgaacatgctttcggtcaagtcgccgaccaccgagatgaacaccacgatagccgctccgagcaagccgaggatgatctgcccgacggaccagcccgcaaccagaccgaccaccgcagtgatcaccaggctcagcaacaggccgccgtacactccctcccagctcttgcccgggctgacctgcggcgccaacttgcgcttgccgaacgccttgccggagaagtaggcgccgatatcagcgccccagaccagcaccatcaccgccatgatcaaccagttacccaaaggctgctgcttgatgaagaccaggccttgccaggccggcagcagaatcagcagaccgatcaccagcttggccgcggcaccggcccaatgctcacgggtacgcggataggtgagcaccaggaaagtcgccagcccccaccagagcaccgcagcacccagcacccaaggcgcgatacctggcaacagctgcatcaggaacaacagcgcagcgaccactactgcataggcaatacgggtcgactgagcctcgaaacccgccaggcgcgcccattcccaagccccgagggtcaccaccagcccgataaacagggcgaaggcggaaccttcgagcaggaaaaaaccgcacaaggcgatcggcagcaggatcagcgcagtaatgattcgttgtttgagcattaaacccgggctccagcttcgacctgctcgctcgttttaccgaagcggcgctggcgagaagcgtaatcggccagcgcagcgcgcatggcatcgtgtttgaagtccggccagaacaggtcggagaagtacagctcggcataagccagctgccagagcaggaaattgctgatgcggtgctcgccacccgtacgaatgcacaggtccggcaatggcaggtcgccagtcgccaggcaggtttgcaacaactcaggggtaatgtcctcaggacgcaggtgccccgcctgaacttcccgcgccaggcgctgagcggcctgggcgatatcccactgaccgccatagttggcagcgatctgcaaaatgaagcggtcactacccgcagtcatcgcctctgcctcgcgcattgccgcctgcaactcaggatggaaacgcgaacgatcgccaatgatgcgcaggctgatgttgttttcgttgaggcgcttggcctcgcggcgcaatgccttgaagaacagatccatcaaggcactgacctcatcggccggccgttgccagttttcactggagaaggcaaacagggtcagcacctcgaccttggcttcggcacagacctcgatcactgcccgcacggcatccacacccgccttgtgcccggcgacgccgggcatgaagcgttttttcgcccagcgattgttgccatccatgatgatcgcgacatggcgcggcaccgaggacggcgcactctgcttggtcttgtccatttaaagcccgacccttatacggccatcaggtccttttctttttcgtcagttgccttagcgatctgagcctcgaactctttgatcagcttgtcgatctcagcaccggcacgacgctcttcgtcttcactgatttccttgtccttggacagcttcttcagatcacccaaggcatcgcgacgaatattgcgcacagcgacccgggcatcttcagcagcagcacgcgcctgcttggtgaagcctttgcgggtttcttcagtcagcggcgccattttgatcagcaacagctcgccaagattggtcggattgaggttcaggccagcactgccgatggccttgtcgattgccccaagcatgttgcgctcgaatggcaccacctgcagggtctgagagtctttcacggtaacgttggccacaccgctcaatggggtgtcagtgccatagtaaggcaccatcacgctacccaggatgctcgggtgcgccttgccggtgcggatctggccaaacgcgtgagccagcgactccagggacttcttcatacgctcttgagcgtctttcttgatttcgttgatcattgttcgccttcctcgatcagggttccttcagcgccgccatgcacgatgttcagcagggcgccgggcttgttcatgttgaatacgcgcaatggcatcttgtggtcgcggcacaggcagatcgccgtcagatccatgacacccagcttgcgatccagtacttcatcgtaggtcagatgatcgaacttctcggcatgcgggtctttgaatgggtctgcggtgtacacaccgtcaaccttggttgccttgagcactacgtcggcatcgatctcgatcgcccgcaagcatgctgcggagtcggtcgtgaagaacgggttgccggtaccggcagcgaagatcaccacttccttggagttcagatggcgcattgccttgcgacggtcgtagtgatcggtcacacccaccatggaaatggccgacatgacgatcgccgagatattcgcacgttccagcgcgtcgcgcatggccaggccgttcatcacagtggccagcatgcccatgtggtcgcctgttacccgatccatgcctgccgcgctgagcgccgcgccacggaacaggttgccaccaccgatgaccaggccgacctgaacaccgatgcccaccagctggccgacttccagcgccatgcgatcgagcaccttagggtcgatcccgaactcttccgagcccatcagggcctcgccgctaagcttgagtagaatgcgtttatagcgagcttgataaccactgccctgctgagccattgcgaatctctcctgcggcgtattttaaaaattctctgcaagctgtttgcagcctgcgttcactctagcttgacgctgtcacagcgccatcagaacacgactttgtaaaccggttccgaaggcaacccaataaattggttaccccatttgaaaagaggctgcgcgcgtgagcgggcagcctctttcgggcgacagttgaaaaaccgtcttactgttgcttggcagcagccagctgtgcggcaacttcttcagcgaagttgtcttctttcttctcgatgccttcacctaccgcgaagcgggtgaacgaaacgatttctgcgccgcctttcttggccagggcacctacggtgatttctggatccttgacgaaagcttgctcaaccaggctggcttcggccaagaacttgctgatacgaccaccgatcattttttcaacgatttcggctggcttgcctttcatcttgtcttcgttcagctgcaggaacacggctttttcgcgctcgatggcttcagcggaaacttgcgatggcagcaggaactcagggttgcttgcagccacgtgcatggcgatgtccttggccagttccacggaaccgcctttcaggacaaccgcaacaccgatcttgttaccgtgcaggtaagtaccgaccacgtcaccttcaacgcgagccagacgacggatgttgacgttctcgccagtcttgccaaccaggaccagacgatcggcttcttgagcttcgatcagcggagcggcatcggtcagcttgtcagcgaaagctttttcgacgctggcagcaacgaatgccttgaaatcgtcctgcagagccaggaagtcggtctgcgagttgacttccagcagaacggcggctttaccgtcgtccttgatggcgatggcgccttcagcagcgatgttgcctgctttcttggcagccttgatggcgcccgaagcgcgcatatcatcaatggctttctcgatgtcgccgccagccttggtcaaggctttcttgcagtccatcatgccttcgccggtacgctcgcgcagttctttaaccaacgctgcagtaatctctgccattttcaaattcctcttggataggttttcaaccattccacccgactcaacgggcgatcaattcttgagctgcgctctcgaaaacccttgatagccgccacacatgacaagaactgcaggggcgccatcggtaaatgatttccgaggtggcaaaaagggggcctagccccctttttgcgtactgagtaaacgctaagcgtcagttactcaggcttcagctgccggcgctggagcgtcttcagcgaatacttcggtgccaccagcaacgttgttgcggccacggatcacggcatcagccatcgaacccatgtacagctggatggcgcgaatggcgtcatcgttgcctgggatgatgtagtcaacgccttccgggctgctgttggtatcgacaacgccgatgaccgggatgcccagcttgttggcttcggtgatcgcgatgcgctcgtggtcaacgtcgatcacgaacagtgcgtcaggcagaccgcccatgtccttgataccacccaggctacgatccagcttttccagatcgcgagtgcgcatcagcgcctctttcttggtcagcttggcgaaggtaccgtcttccgactgaacttccaggtcacgcagacgcttgatggaagcacggatggtcttgtagttggtcagcatgccgcccaaccagcggtgatcgacgtacggcgaaccgcaacgtgctgcttcttcagcaacgatcttgccagcggaacgcttggtgccgacgaacagaatcttgtttttgccctgggccagacgctctacgaaagtcagagcttcgttgaacattggcagggttttttcaaggttgatgatgtgaatcttgttacgcgcgccgaaaatgtacttgcccattttcggattccagtaacgggtttggtgaccgaagtgcacaccggccttcagcatatcgcgcatgttgacttgggacatgatagttccttaataagtcgggttaggcctccacgtatcccaatgaccaaccaacagcttgtgctgagggcacccaggtcatcgtgtcgacacgtgtgtgggtttaggcttttcagggcatccccggaaagcggcgcattttataccacaagaagggaaaaaacggaacccggattctcatctcccccggagcgcttttttgctccccctttggaatcgggccagaatgctccactgttatagaaagaagcgacgcacagagcctcagatttgccccggggctctgttagaatcgcacctttgaggcttttgaaagcgcggcgaccccacaacgggatctgccttcgatacaccgttttcaagccattccgtgtttatccgcgccactgagcgtcaagagagcctgtatgaccgtcaccctcaaaactcccgaggacatcgcaaaaatgcgtgtcgccggcaaactggccgccgaagtgctggaaatgattgccgagcatgtcaaacccggcgtgaccaccgaagagctggaccgcatctgccacgactacatcgtcaatgtgcagcatgcgattcccgcgccgttgaattacaagggttttcccaagtccatctgcacctcgatcaaccacgtggtgtgccacggcatcccgaacgagaagccgctgaaggatggcgacaccctgaacatcgacgtcaccgtcatcaaggacggctaccacggcgataccagccgcatgttccacgtcggcaccgtgccggtctgggccgagcgcctgtcgcagatcacccaggaatgcatgtacaaggccatcgaactggtgaagccgggctgccgcctgggcgacattggcgaagtcatccagaagcacgctgaaaagaacggtttctcggtggtgcgcgagttctgcggccacggtatcggcaaggtgttccacgaagagccgcagatcctgcactacggccgcgccggcaccggcatggaactgaaagccggcatgaccttcaccatcgagccgatgatcaaccagggcaaggccgacaccaaggtgctgggcgacggctggaccgcgatcaccaaggaccgcaagctctccgcgcagtgggaacacaccctgctggtgaccgagaccggctacgagatcttcaccctgcgcagcgatgacaccatcgcgcgcgtctcggcctgatccacgcagctgcgccctgacctatagatagaaaggaaagccaatcgatgccgcaggtggatcccgaattgttcgaccgcggccagttccaggcggaactggccctgaaggcaagccctatcgctgccttcaagaaagccattcgtcaggcacgcgaagtgctcgacgagcgctttcacagcggacgggatatccgccggcttatcgaggaccgcgcctggttcgtcgataacatcctgcaaaaggcctgggaccagttcgactggagcgacgatgccgacatcgccctggtggcggtcggcggctacggtcgcggcgagctgcacccctactcggacatcgacctgctgatcctgctggacagcgccgaccacgagattttccgcgactccatcgaacgtttcctgaccctgctctgggacatcggcctggaagtcgggcaaagcgtgcgctcggtggaggaatgcgccgaagaggcccgcgccgacctgacggtggttaccaacctgatggaaagccgcaccatctgcggccccgaacgcctgcgccagcgcatgctcgacgtcaccagcacggcgcacatgtggccgagcaaggacttcttcctggccaagcgcgccgaacagaaagcccggcaccacaagtacaacgacaccgaatacaacctggaacccaacgtcaaaggctcgcccggcggcctgcgggacatccagaccatcctctgggtcgcccgtcgccagtacggcacgctgaacctgcgagccctggccggcgaaggcttcctggtggaaagcgagaacgcgctgctggcttcgtcccaggagttcctgtggaaagtccgctacgccctgcacatgctcgccgggcgcgccgaagaccgcctgctgttcgatcaccagcgctcgatcgccaagctgctggggttcgagggcaacgatgccaagcaggctatcgaaagcttcatgcaacagtactaccgggtggtgatgagcatcgcccagctcagcgacctgatcatccagcatttcgaggaggtcatcctcgccccggaagacgaagcaccgccgcagccgatcaactcgcgcttccagctgcacgacggctacatcgaggcgatcaacgccaacgtgttccgccgtaccccgttcgccatgctggaaatcttcgtgctcatggcccagcacccggagatcaagggcgtacgcgccgacaccattcgcctgctgcgcgaaaatcgccacctgatcgacgacgatttccgccacgacattcgcaataccagcttgttcatcgagctgttcaagtgcgagatcggcatccaccgcaacctgcggcggatgaatcgctacggcattctcgggcgttatctgccggagttcggccatatcgtcggacagatgcagcacgacctgttccacatctatacggtcgacgcccacaccctgaacctgatcaagcacctgcgcaaactgcagtacacccaggtttcggagaaattcccgctggccagcaagctcatggccaagctgcccaagcccgagctgatctacctcgccgggctctaccatgacattggcaagggccggcacggtgaccactcggatatcggcgccgtggacgcggaagccttctgcatccgccaccagttgccgctgtgggacacccgcctgatcgtctggctggtgcagaaccacctggtgatgtcgaccaccgcccagcgcaaggacctgtccgacccgcaggtcatccatgatttcgcccagatcgtggtcgaccagacccgcctggactatctctacgtgctgacggtttccgacatcaacgcgaccaacccgacgctgtggaactcatggcgcgccagcctgttgcgccagctctacaccgagaccaagcgcgccctgcgccgcggcctggaaaacccagtggaccgcgaagagcagatccgccagacgcaaagcgcggccctggacatcctggtccgcgccggcaccgacccagacgacgtcgagcagctctgggcgcaactgggtgacgactatttcctgcgccacaccgccggcgatgtggcctggcacagcgatgcgatccttcagcagccggccgacggcggcccgctggtgctgatcaaggaaaccacccagcgcgaattcgagggtggcacgcagatcttcatctacgccccggaccagcacgacttcttcgctgtgaccgtggccgcgatggaccagttgaacctgaacatccatgacgcccggatcatcacctcgagcagccagttcaccctcgacacctatatcgtgctcgacaacgacggcggctcgatcggcaacaacccgcaacgcgtcaaacagatccgcgacggccttaccgaggccctgcgcaatcctgacgactacccgaccatcatccagcgtcgggtaccgcgtcagctcaagcacttcgccttcccgccgcaagtgactatccacaacgatgcccagcgcccggtcaccgtgctcgaactgagcgcgcccgatcgccccggcctgctggcgcgcatcggcaagatcttcctggagttcgacctgtcgctgcaaaacgccaagatcgcgaccctgggcgagcgcgtggaagacgtgttcttcattaccgacgcgcacaaccagcaactgtccgatccccagctgtgcagccgactgcaggacgccatcgtcgaacagctgagcgtcagccacgaaccgcctaccgccttgacgcgcctgaacttctgaccacgcgccacgacccgctttgagtgagacaccgcaccgatgaacaacgctctgaaccagctgcagccctacccgttcgagaaactccgcgccctgctcggcggcgtccagcccaacccggccaagcgccctatcgcgctgtccatcggcgaacccaagcaccgctcgccgagctttgtcgccgaggccctggccaataacctcgaccagatggccgtgtatccgacgaccctggggcttccagccctgcgcgaagccattgccagctggtgcgaacggcgttttggcgtgcccgacggctggatcgacccggcacgcaacgtgttgccggtcaacggcacccgcgaggcgctgttcgccttcacccagaccgtggtcaaccgcggcgacgatgcactggtggtcagcccgaaccccttctatcagatctacgaaggcgcggccttcctcgccggcgccaagccgcactacctgccgtgcctggatgaaaacggcttcaagccggatttcgacgcggtaccggccgagatctggcagcgttgccagatcctgttcctgtgctcgccgggcaacccgaccggcgcgctgatcccgatcgaaaccctgaagaaactcatcgccctggccgaccagtacgatttcgtgatcgccgccgacgagtgctacagcgagctgtacttcgacgaacagaccccgccacccggcctgctcagtgcctgcgccgagctgggacgccaggacttcaagcgttgcgtggtgttccacagcctgtccaagcgctccaacctgccgggcctgcgctccggcttcgtcgccggcgacgcggagatcctcaagggcttcctgctgtaccgcacctaccatggctgcgccatgccggttcagacccagctggccagcatcgccgcctggaacgacgaagtgcatgtgcgcgccaaccgcgcgctgtatcgcgagaagttcgatgcggtgctggagatcctggcgccggtactcgacgtgcaacgcccggacggcagcttctacctgtggccgaacgtggcgggcgacgacacggcgttctgccgcgacctgtacgagcaagaacacgtgaccgtggtgccgggctcctacctgtcacgcgacgtcgacggcagcaacccgggagccggtcgggtgcgcatggccctggtggcgccattggccgaatgcgtggaagccgccgagcggatccgcgatttcgttcagcgccgtaagtaactcacgcccctgtaggagcgaggcttgcccgcgatagagataacgccgtacagctgaaacactgcgttatcgttcatcttgggcacgcctcgctcctacaggagacaggtgctatttcacctgccccagattggcctcgctgaggtccagctcgcccaatatctcgcgcaacacgtcgtcgccgatctggtgctggcggctcaaccgatacaactccagccgctgcgcccgcagcgccttcaaacgcaacttgcgctccagcaaatccatctgaaacgccagcgcctgggcttcggcggaatcgttgaacacctccagttgatggcgatactccgacatcagccgccccttgagctcggtggccagcgccgcctgggccgcatccggcgagttggccccatcggccacttcctcggcctccagggcatggatcgccgcctcggcggttttgcgccaggcgtcacgcacttcggcatgccgcttctcgtcaggactcttctggatgccccgcagcaagagcggcaaggcgatacaggcggccaccagcgacaacaggatcaccccggcggcaatgaagatcagcaggtcgcgctcgggaaaagcctcgcccgcgcccagcaacagcggcaccgacatgacgcccgccagggtcaccgccccgcgtaccccgcccaccgtcagcaaccagcaggaacgcgcggtcggcaccagggtcagctcacccttgccgcgccagcggcgcaacagaccggacaggcgccagatgctttgcacccagatgaaccgcagcaccagcaataccaggaagatcgctcccacatccaggcagcgatagaacagggtcggccacaaggtggtttcgtggctgaccacggccttgatgatgtccggcagttgcaggcccaacagcagaaagatcaggccgttgaaggcgaactccagcaacgaccagacactgcggttgagcaagcgggtgctggtctgccggggcaacagatcgagccagctctgcatcatccccgccgccaccgccgagaggatgcccgaggctcccaggcgctcggccagcacgtaggcggcgaacggcagcaacagcatgaacaccacatgggtcgccgggtcgtcccagccgcgggcgatcatccaggcccgcaagcgcccgaccagccagctcagggccacgccgaccgccaggccgccgacggccaccaggacaaacgtcaggctggcattggccagggaaaacaccccggtcacggccgccgccagggcgaacttgaaggtcaccaggccggaggcgtcgttcatcagcgcctcgccttgcagcatgtgcatcaagggcgtcggcagacggttctgggaaatcgccgagaccgccacagcgtcggtcggcgacagcaccgccgccagggcgaaggccaccggcaagggaatggtcggcagcaaccagtgaatgaaataaccggcccccaccacggtgaacagtaccaggcccacggccagggtcagaatcggcccgcgcaggcgccacagctcacgcttgggcatgcgccagccatcggagaacagcagcggcggcaggaacaggaacagaaacaattccgggtccagggccacgtgcagccccagggtgggccaggccagcaaggctccagcggcgatctgcagcagcggcaacggcaacggaatcacccgtccgaccaagcgcgagagactcaccagcatcagcaggataaggacggtataggcggtttgcataaagcggttttcccaatcgatcagcagcggacttcaggcaacaggttaccgtcgaagtgccatattagccgcttaagctggggtctcgccgctgcacaaaagtcgcaagcggcccatgccgctgtcacacaaagctacaaagccgggccttcgccgacgccgaaccggcgcgggcatggcataatccgtgacctttaactccagcatctcaaaagggggcaattccttgaccgcttcaagcaaaacgttgcaccttttcggcatcaaagcctgcgacaccatgaaaaaggcgcgcacctggctcgatgaacacgctgtcagctatgacttccatgactacaaagcggccggaatcgaccgcgaacacctggtccagtggtgcaacgagcacggctggcaggtggtgctgaaccgtgcgggcacgacctttcgcaaactcgatgacgaacgcaaagccgatctcgaccaggcgaaagcgatcgaactgatgctcgcgcaaccttcgatgatcaagcgcccggtgctcgatctcggcgaccgaaccctgattggcttcaagcccgatatctacgcggcagaaatcaaataacgcctgcccgctcaattttgtaagaggtaacagcatgtccactaccctgttcagcctggcctttggtgtcggcactcaaaaccgtcaaggcgcgtggctggaagtgttttacgccgcgcccctgctcaagccgtccgcggaaatcgttgccgccatcgccccggtgctgggttacagcgaaggcaaccaggccatcaccttcaccaccgcccaggccgcagagctggccgacgccctgaaaagcatcgacgccacccaggccgcgctgctgacccgcctggccgagagccacaagccgctggtcgccaccctgctggccgaagacgcccagttgacctccaccccggaggcctacctgaagctgcacctgctgtcccaccgcctggtcaagccgcacggcctgaacctggccgggatcttcccgctgctgccgaacgtggcctggaccaaccagggcgcggtcgacctcggcgagctggccgagcgtcaactggaagcccgcctgcgtggcgagctgctggaagtgttctcggtggacaagttcccgaaaatgaccgactacgtggtaccggctggcgtgcgtatcgctgacgccgcgcgtatccgcctgggcgcctatgtgggcgaaggcaccactgtgatgcacgaaggtttcgtcaacttcaacgccggtaccgaaggcccgggcatgatcgaaggccgggtttccgctggcgtgttcgtcggcaagggttcggacctgggcggcggttgctcgaccatgggcaccctgtcgggcggcggcaatatcgtgatcaaggtcggcgaaggctgcctgatcggcgccaacgccggtatcggtatcccgctgggcgaccgcaacaccgtggagtcgggcctgtacgtgaccgcaggaaccaaggtggcgctgctggacgagaacaaccagttggtcaaggtagtcaaggcccgcgagctggccggccagcctgacctgctgttccgtcgcaattcggaaaccggtgccgtggagtgcaagacccacaaatcggccatcgaactgaacgcagcgctgcacgctcacaactaagcgtcacgcacctctacctgcaggagcgaggctggcccgcgaaactttgggctgcctcgagagccccttggcgggcagcctcgctcctaccggttacaggtccgtatacccgcccatgttcaccagggcccgatagcatgatgattccttctccctggcgtgccgacttcccggccatcgccgccctgcaacggcaggaccagacctacctggacaacgccgccaccacgcaaaaaccccaagccctgctggacgccctggcgcactactacgccaatggcgcggccaatgtgcatcgcgcgcagcacctgcctggcgctcacgccacccaggcgttcgagaacagccggcacaaggtggcgcagtggctgaacagcggtgaccgcgggcagatcatctttacccacggcgcgacctccgcgctgaacctcctggcctatggcctggaacaccaattcaacccgggcgacgaaatcgtcatcagcgccctggagcatcacgccaacctgctgccctggcagcaactggcgcaccgtcgcggcctcaacctggtggttctgccgctggacgacgacggcctgatcgatctcgacgccgcggcccgcctgatcggcccgcgcacccggctgctggccgtcagccagctgtccaacgtgctcggtgcctggcagcccctgccgcagttgctggccctggccaaggcgcacgccgccctgaccgtggtcgacggcgcccagggcgtggtccacggccgccacgatgtgcaggcgctgggctgtgacttctatgtattctccagccacaagctctacggcccggacggcgtcggtgtgctgtacggacgcaccgaggcgctgcaaggcctgcgtcactggcagtttggtggcgagatggtccagcaggccgaataccagcacgccagcttccgccccgccccgctgggtttcgaagcgggtacgccgccgatcgccagcgtgattggcctgggcgcgaccctggattacctcagcggtctcgaccaggacgccgtcagcgcccatgaagccgcgctgcatgactacctgctgcacggcctactggcccgcaaaggcctgcgcctgctgggcaagccgcagctggcactggtcagcttcgtggtcgatggcgtgcacaacgccgacctggctcacctgctgaccgaacagggcatcgccgtgcgcgccgggcatcactgcgccatgccgctgctgaaaagcttcggcctggccggggcgatccgcgtatccctggcgctgtacaacgactccgaggacctggagcgcttcttcgaggccctcgatcaggcgctggagctgttgcgatgagcctgcccgccgaggccctggcggccctcgacagctttcagggcgctcccggttgggaacagcgcgcgcgcttgctgatgcaatggggcgaacgcctggcgccgctgagcgacgccgacaaggtcgaggccaatcgggtgcatggctgtgaaagccaggtctggctggtgggcaccttgcaggacggtcactggcagttcgccgccagcagcgatgcccgtctgatccgtggcctggtggccctgctgctggcgcgggtcaacggtttgtccgccgaggaactgcaacgggtggacttgccggactggttcaatcaactgggcctgtcgcgccagctgtcaccctcgcgcagcaatggcttgaacgcggtattgcagcggatgcgcgagctggctggcacgcgctgacgctggccgacacaaccgctgagcctggataagacacggacctgtgtagccgctgccgcaggctgcgatcgactccgcaggagacgtgctcttcagggcctcgcaagccccttcgggccttatcgcagcctgcggcagcagctacaggggtttgacccggtccgccgggcgccgcacgccagccaccagcttgtccaccgccttggtcgccgcaaccatgccgaaggtcgcggtcaccatcatcaccgcgccaaaaccgccggcgcagtcgagcttcacaccatcgccgacaaagctcttctgcaggcagatgctgccgtccggtttcgggtagcgcagctgctcggtggaaaacacgcaaggcacgctgtagtggcgggtcacggtgcgggaaaaaccgtagtcgcgacgcagggtcgagcgcactttcgaggccagcgggtcgttgaaggtgcggttcaggtcgcagacctggatcagtgtcgggtcgatctgcccgcccgcgccgccggtggtgatgatctggatcttgcgccgcttgcaccaggcgatcagcgccgccttggcgttgacgctgtcgatgcagtcgatcacgcagtcgatgttcggcgtgatgtattcggccatggtctcgcgggtgacgaagtccgccaccgcatgcacggtgcaggccggattgatcccgcgcaggcgctcggccatgacctcgaccttggctttgccgaccgtgctgtcgagggcatgcaattgccgattgctgttgctgacgcagacgtcgtccaggtcgaacagcgagatctcgcccacgccgcaacgggctatggcttccgccgcccaggagccgaccccgccgaccccgacgatcgccacatgggcggcgcgcaagcgttccagcccctcgatgccatacaaccgggcgacgccagcaaaccgcggatcttctgtactcatgaccattaccccaaaaaccggcgcgcattatagggccgatgcccgccaagagcatctttgccctatgaatggcagtcggggctgctttaatgagggaaaaatctgaaaatttcgtcgccgagaacttaaatcaagttgaattgcccaacctgcggctttcccctgtgcgctgtacgctcagccgaaggccagtgtaggatgcgcgccgcttggcgcatgccgaccgttcccccgttccacaccctttggaacccgaaatagctatgtcatcgcgtaaatttggactcaacctggtggtggttctggcaatcgccgccctgttcaccggcttctgggcactggtcaaccgcccggtttccgcccccaattggcctgcacaaatctccggcttttcctactcgcctttccagctgggccagttcccgcagaaagaccagttcccgaccgacgacgaaatgcgtcgcgacctggagatcatgagcaagctgaccgacaacattcggacctactcggtcgacggcacgctggagaacatccccaagctggcggaagagttcggcctgcgcgtgaccctcgggatctggatcagcccggacctggagcgcaacgagcgtgaaatcacccgcgccatcgacatcgccaacaactcgcgcagtgtggtgcgcgtggtggtcggtaacgaagcgatcttccgcaaggaaatcaccgccgaccagttgagcgtcctgctcgatcgcgtgcgggccgcggtcaaggtgccggtcaccacttccgagcagtggcacgtctggaaagaacacccggaactggcccagcacgccgacctgatcgccgcccacgtcctgccctactgggagtccatcccgatggacaaggccgggcagttcgtcctcgaccgcgcccgcgacctgaaacaaatgttcccgaaaaaaccgctgctgctgtccgaggtcggctggccgagcaacggccgcatgcgtggcggcgccgacgccagcccggcggaccaggcgatctacctgcgtagcctggtcaacaagctcaaccgtcagggctacaactacttcgtgatcgaagccttcgaccagccgtggaaggccagcgacgaaggctcggtaggcgcctactggggcgtgttcaacgccgcgcgccagcagaaattcaacttcgaaggcccggtggtggcgattccgcaatggcgcgtgctggccatcggctcggtggtcctggcgctgctgtccctgaccctgctgatgatcgacggctcggccctgcgccagcgcgggcggaccttcctgaccttcatcgccttcctctgcggctcggtgctggtgtggatcggctacgactacagccagcaatacagcacctggttcagcctgacggtgggcttcctgctcgccctgggtgcgctcggggtgttcatcgtattgctcaccgaggcccatgaactggccgaggcggtctgggtgcacaagcgccggcgcgagttcctgccggtcgaaggcgactccaactaccggccgaaagtctcgatccatgtgccgtgctacaacgagccgccggaaatggtcaaacagaccctcaatgccctggccaacctcgattacccggacttcgaagtcctgatcatcgacaacaacaccaaggacccggcggtctgggagccggtgcaggcctattgcgaagccctcggcccgcgcttcaagttcttccacgtcgcgcccctggctggcttcaagggcggcgcgctgaactacctgatcccgcacaccgccaaggacgccgaagtgatcgcggtgatcgactcagactactgcgtcgatcgcaactggctcaagcacatggtgccgcacttcgccgacccgaaaatcgccgtggtgcaatcgccgcaggattaccgcgaccagaacgaaagcaccttcaagaagctctgctacgcggaatacaaaggcttcttccatatcggcatggtcacccgcaacgaccgtgacgcgatcatccagcacggcaccatgaccatgacccgccgttcggtactggaagaactgggctgggccgactggtgcatctgcgaagacgccgagctgggcctgcgggtgttcgagaaaggcctgtcggcggcgtactaccacaccagctacggcaaaggcctgatgccggataccttcatcgacttcaagaaacagcgtttccgctgggcctatggggcgatccagatcatcaagcgccacaccgccagcctgctgcgcggcaaggacaccgagctgacccgtggccagcgctaccacttcctcgcgggctggctgccgtgggtggcggacggcatgaacatcttcttcaccctcggcgccctgctctggtcggcggcaatgatcatcgtgccgcagcgcgtcgatccgccgttgctgatcttcgcgatcccgcccctggcgctgttcgtgttcaaggtcggcaagatcatcttcctctaccgccgggcggtcggggtcaacctcaaggacgcgttctgcgcggccgtggcgggcctggcgttgtcccataccatcgccaaagcggtgctgtacggcttcttcaccagcagcattccgttcttccgcacaccgaagaacgccgacaaccacggcttctgggtggcgatctcggaagcccgggaagagctgttcatcatgctgctgttgtggggcgcggcgctgggcatctacctggtgcagggcggcctgccgagcaacgacatgcgcttctgggtgaccatgctgctggtgcagtcgctgccgtatgtggcggcactggtcatggccttcctgtcgtcgctgccaaaaccgcttgccgaaagcacgccggtggcagccgcataaatcgcggcaaagcactaaacggcggcctctggccgccgttttgctttaagatatccgccattttgcgcgccttgccccattaccgtaggcgcgaggcttgcccgcgatagccacgacgcggtttgcctgagacacctcaggttttccatcgcgggcaagcctcgcgcctacacataacgccttgcaccggagtttccccatgacggcccacgccgacctttcgccgaccctgcaactcgcctgtgacctgatccgccgcccgtcggtgacgccggtcgacgccgactgccagaagctgatgatgcagcgcctgggcgatgccggcttcaagctggagccgatgcgcatcgaggatgtggataacttctgggccagccatggcaagcacgaaggcccggtgctgtgtttcgccggccataccgacgtggtaccgaccggcccggtccaggcctggcagaacgacccgttcgacgcgttgatcgacgagcacggcatgctctgcgggcgcggcgcggcggacatgaaaggcagcctcgcggcgatgctggtggcggccgagcgttttgtcgccgactacccggagcacaaaggctcggtggccttcctgatcaccagcgacgaagaaggcccggcccaccacggcaccaaggcggtggtcgagcgcctggcggcgcgcaaggagcgcctggactggtgcatcgtcggcgaaccgtcgagcaccagcctggtcggtgacgtggtcaagaacggccgtcgcggctccctcggcgccaaactcacggtgcgcggcgtgcagggccacgtggcctacccgcacctggccaagaacccgatccacctggcggccccggccctggccgaactggccgcggaacattgggacgacggcaatgccttcttcccgccgaccagcttccagatttccaacctgaattccggtaccggcgcgaccaacgtgatccccggcgagctggtggcagtgttcaacttccgcttctccaccgaatccacggtcgaaggcctgcagcagcgcgtggccaccatcctcgacaagcacggcctggactggcatgtggagtgggcgctgtcgggcctgccgttcctcaccgagccgggcgccctgctcgacgcggtgtcggccagcatcaaggacgtcaccggccgcgagaccaaggcctccaccagcggcggcacctccgacgggcgcttcatcgccaccctcggcacccaggtggtcgagctgggcccggtcaacgccaccatccaccaggtcaacgagcgcgtgctggccagcgacctcgacgtactgaccgaaatctactaccagaccctgatcaagttgctcgcctgatgcttgcctgccctatctgcgcggcgcccctgagcgccgtcgacaacggtgtcgtgtgcccggccgggcaccgcttcgaccgcgcccgccagggttacctgaacctgctgccggtgcagcacaagaacagccgcgacccgggcgacaaccaggccatggtcgaagcccgccgcgactttctcaatgccggccattacgctccggtggccaggcgcctggccgaactggccgccgagcgcgccccgcagcgctgggtcgatatcggttgcggcgagggttactacaccgcccagatcgccgaagccctgccccaggcggacggttatgccctggacatctcccgggaggcggtcaagcgcgcctgtcgccgtgccccgcagctgacctggttgatcgccagcatggcccgggtgcccctggccgacgccagttgccagtttctcgccagtgtcttcagcccgctggactggcaggaagccaagcgcctgctcagccctggcggcggcctgatgaaggtcggaccgaccagcggccacctgatggaattgcgcgagcgcctgtacgacgaggtccgcgaatacaccgacgacaaacacctggcgctggtgcccgcgggcatggcgctgcaacacagtgaaaccctggacttcaagctgacgctgagcaatccgcaggatcgcgctaacctgctggccatgacgccccatggctggcgcgcaagtgccgaacgccgggccagcgtgatcgagcaggccgagcccttcgaggtcagcgtgtcgatgcgctacgattacttcgtgctgcaataacccattaatccacggcctcgagcagcgactcgaggccgaataaatccgcgaatggatttttcagacccgcagtgaggacatccatgcgccaaccggatatcgagatttacctgaaagacgccgacgtcgaccacaaggccatcgccgcctggctcggcgcggccctgggcccgtgcagcgactgggtgcagaaaggccagacctacaaatgcaaggcgggtagcgtgccagtgacctggctgccgaaagccgtgggcaagtggaatagcctgtacctggaaagcgaccagacaccgtgggacgacgacatcgcctgcgcccgcgccgccttcgccgcgctgaacgtcgaagtgcgctgcgcaccgggcagctgggtcgaggaagaaggtgaggaatcggccgaccgctggattcgcatcagcgccgacggggaagaagagattacctggcgtaccgcctgactctgattactgtaggtgcgaggcttgcccgcgatagcgttatcgcgagcacgcttcgctcctacaaggcacagcgcttacaagccgactacatcctctgcctgcaaacccttctgcccctctaccacggcgtattcaacttgctgcccttcggtcagcgagcggtggccttcaccacgaatagcacggtagtggacaaatacatcggcaccaccttcacgctgaatgaagccgtagcccttggcgtcgttgaaccacttcacgctgccggtctcgcgagttgccatcaatccatcctccgtctttttattatcagtcggcttactgaaacgaagccgtgagaactttcgcctggacccgggtttctattgatgggccccgcatgcccaggcgtcagtcgggcgagtatatgacaggcagaaaaactctcaactcaatcttgtttgccgcttttttgccgattttcggtgaatccggcacactagccgccccgagcaactgctcggttttttccactaaagcagaagccgtatgacccgctccccgttccgccgtcttgtgtttggcaccttgcgccgactgttgtacctctgggttcgctcggagacgatcaaccagtcgtccttcaccctcaacctcgaccgcagtcgtccggtgttctacgtcctgcaaaacccttcgctcaccgaccttgccgtggtcgataccgagtgcaccaaggccgggttgccgcgcccggtactgccggtctcggtgggcaacctgctggaacccgccgcgttcttctacctgaccccggccccagactggctcggccgccaggacaaacgcggcgcgccaccaaccctgacccgcctggtcagcgccctgagccagaatgccgccgaagacgcgcagatcattccggtcagcgtgttctggggccagtcgcccgacagcgaatcgagcccgtggaaactgctgttcgccgacagctgggcagtcaccgggcgtctgcgccggctgctgagcatcatgatcctgggccgcaagacccgggtgcaattttccgcgccgatccacctgcgcgaactgatcgagcacaacaagggccacgagcgcaccgtgcgcatggcccagcgcatcctgcgggtgcatttccgcaacctgaaggccgcggtgatcggcccggacatttcccaccgccgcaacctggtcaagggcctgctgaaccagccgctggtcaggcaggcgatcctcgacgaagccgaacgggaaaagatctccccggaaaaagccaaggccgtggccctgcgttatggcaacgagatcgcctcggactacaccttcaccgcgatccgcttcctcgaagtggtgctgagctggttctggaacaagatctacgacgggatcaaggtcaaccacatcgaaagcgtgcagaaagtcgccccgggccacgaagtgatctacgtgccctgccaccgcagccatatcgactacctgctgctgtcctacctgctgttccgcaacggcctgaccccgccgcacatcgccgccgggatcaacctgaacatgccggtgatcggcagcctgctgcgcagggggggagcgttcttcatgcgccgcaccttcaagggcaacccgctctacacctcggtgttcaacgaatacctgcacaccctgttcaccaagggtttcccggtggagtacttcgtcgagggcgggcgctcgcgcaccgggcgcatgctgcaaccgaaaaccgggatgctggccatcaccctgcgcagcttcctgcgctcctcgcgcatgccgatcgtcttcgtcccggtgtacatcggctacgagcgcgtgctggaaggccgcacctacctgggcgagctgcgcggcgcgagcaagaagaaagagtcgatcttcgacatcttcaaggtcatcggcgccctcaagcagcgtttcggccaggtggcggtgaacttcggcgagccgatcaagctggccgagttcctcgaccaggaacaaccgggctggcgcgcccaggagctgggcccgcagttcaagccggcctggctcaacgaaaccaccaatcgcctgggtgaaaaagtcgcccagcacctgaacgaggcggcggcgatcaacccggtcaacctggtggccctggcgctgctgtccaccagccgcctggccctcgacgaccgcgccatggcccgggtcctggacctgtacctggcgctgctgcgcaaggttccctactcgccccacaccaccctgccggaaggcgatggccgggccttgatcgagcacgtgaaggacatggacctgctgtccgagcagagcgatgccctgggcaagatcctctacctggacgagcagaacgccgtcctgatgacctactaccgcaacaacgtgctgcacatcttcgccctgccggcgttgctggcgagcttcttccagagctcgtcgcgcatgagccgcgaacagatcctgcgctacacccgggcgctgtacccctatctgcaatcggagctgttcatccgttggtccctggacgagctggacggggtgatcgaccaatggctggaggccttcgtcgagcaaggcctgctgcgcttcgagaaggacctgtacctgcgtccggccccgagttcgcggcatttcgtgctgctgaccctgttgtccaagagcatcgcccagaccctgcagcgcttctacatggccatctcgctgctgctcaacagcggccagcgcagcatcagcgccgaagagctggaagacctgtgcacggtcatggcccagcgcctgtcgatcctgcatggcctgaatgccccggagttcttcgacaagagcctgttccgccacttcatccagaccttgctggagcaagacgtgctgcgccgcgacgaggccggcaagctgagctaccacgaactgctcggcgaactggccgagggcgcggccaagcgcgtgctgccggcggagattcgcctgtcgatccgccaggtggccctgcatcgcagcgaagacgccgccgagcaggtcgccgcaccgcagcaaaacgactagattcttatcggcgccaggcggtttctggcgcccctcgatacggagatccatcatgaaaaagctcaccctgctcgcccttaccaccctgctcggggcctgtaacagcatgcaacctgccagcaaagccagcctcgatggtgaagtcttctacctgcaacgcatcgccctgccgccagccgccaccctgagcgtcagcctgcaggacgtgtcgctggccgacgcccccgcggtgctgctggccgaacagaagggcccggtcaaaggccaggtgccgctgcccttccacctcagctacgacccggcccaggtcaaacccgggcaccgttattcggtcagcgcgcggatcgaagtggctggcaaactgctgttcgtcaccaccgagcacaacggggtgaaactcgacggcagcgatccgcaaccgctgaaaatccgcgtcgacgcggttcgctaatcccttttctcgaacaaggaagctgccatgctccgttcttcccttcgcttcaccagcctgtgcgccggcctgctgatctgtgccagcgccctggcgctgtccctcggcgacctgtcgcagcaagacgccaccggcggcctcaaggacgccctgacccagggagcccaggtcgcggtcaaacaactgggcaccgccggcggtttcagcaacaacccggacgtgcgcatcgaactgccgggtaacctcggcaaagtggcaaagaaaatgaagcagttcggcatgggcgcccaggtcgaggaactcgagaccagcatgaacaaggccgccgaggccgccgtgccgcaggcccaggcgctgctggtggatgccgtgaagaagatgagcgtggaggacgccaagggcattctcagcggtggcaaggattccgccacccagtacctgagcaagaccagccgcgaacagatccgcgtgaagttcctgccgatcgtcaaacaggccaccgaccaggtgggcctggccaagcagtacaacgccttcgccggccaggccgccaccttcggcgtgctggatgcgaagaacgcgaatatcgaaagctacgtgaccgaacaggcgctcaacggcctgttcgagatgatcggcaaacaggaagcgaccattcgcgagaacccggcggcagcggccaccagcctggcgaaaaaagtcttcggtaccctctgaacccacccgatcccctgtaggagcagccggtcgacgctcgattgctcgcgatagcgtccgctgcgtcatcaccgtgaatggccgctgcgcggatcgcgagcaagctcgctcctacaaagggcgcatcaggttttcctgacccggaaccacgccgcatacaacgccggcaggaacaggagggtcagcgccgtcgcgacaatcagcccgcccatgatcgccaccgccatcggcccgaagaacacgctgcgtgacagcgggatcatcgccagcaccgccgccagcgcggtcagcacgatcggccggaaacgcctgaccgtcgcctcgatgatcgcctgccacggcgtaagcccggcagcgatgtcctgctcgatctgatccaccaggatcaccgagttgcgcatgatcatccccgacagcgcgatggtcccgagcatcgccacgaagccgaacggctgacggaacaccatcaggaacagggtcacgccgatcaaccccagcggcgcggtgaggaacaccatcgccgtgcgcgagaaactgcgcagttgcagcatcagcagggtcagcaccaccacgatgaacagcggcacgccggccttcaccgagttctgcccgcgcgccgagtcttccacggtgccgccgacgtccagcaggtaaccgtccggcagttcggcgcggatcggctccagggtcggcaggatctgttgcaccagggtcgccggctgttccttgccatagatgtcagcccgcacggtgacgttcggcaggcggttgcggtgccagatgatgccttcctcgaagccgtactccagggtcgcgacctgcgacagcgccacgctcttgccgttatcagtgggcaccgccaggctcgacagcagcgacagctcggtgcgttcatgcaaggtcccgcgcagcaggatctcgatcaactcgttgtcttcgcggtactggctgacgctggagccagtcagcgagctttgcaggaatttcgccaggttagccgtgctcacacccagggcccgcgcacggtcctgatcgatattgaggtagaccaccttgctcggttcttcccaatccaggtgcacgttgaccacgtgggggttctcgcggaccttggccgccaccttgcgcgccagggcccgcacctcttcgatgtgctcgccggtgacgcgaaactgcaccggatagcccacgggcgggccgttctccaggcgggtgactcgcgaacgcagggccgggaactgttcgtcgagggtttcgatcagccaactgcgcaggctttcacgctcctcgatggtcttggccagcaccacgaactgggcaaaactcgccgccggcagttgctggtccaggggcaggtagaaacgcggcgaaccggtgccaacgtaggctacatagttatcgatgccggcatgctccttgagcagcgcctccaggcgcttgacctgctcggcggtgttgctcagggacgcgccctcggccagcttcaggtcgaccatcagctccaggcgtccggaagccgggaagaactgctgcggcacgaaacggaacagcatcaccgaggcaatgaacagcagcacggtcagggcaatcacggtcttgcgccggcgcacgcaccattccaccatccgccgcacccgctgatagaacggcgtgccgtacggatcgggctggccgtcggcgctgccgtgcttggccgcgtgcagcttggccaggtccggcagcagcttctcgcccaggtagggcacgaacaccaccgcggcgatccaagaggccagcaaggcgatggtcaccacctggaagatcgaacgggtgtattcgccggtgccggactgcgccgtggcgatcggcaggaaacccgcggcagtgatcagggtaccggtgagcatcgggaacgcggtgctggtccaggcgtagctggcggccttgagccggtcgtagccctgctccatcttgatcgccatcatctccaccgcgatgatcgcgtcgtccaccagcaggcccagcgccagcaccagcgcaccgagggagatcttgtgcaggccgatccccaggtaatacatggtggcgaaggtcatcgccagcaccagcggaatcgccaaagccaccaccatgccggtgcgcacgccgagggaaaagaagctcaccagcagcacgatcgccagggcttccaccaacacctggacgaactcgccgacgccggttttcactgcggccggctggtcggagaccttacgcagctccatgccggcggggaggtttttctggatccgggcgaactccagttccagcgccttgcccagcaccaggatgtcgccgccgtccttcatcgccacggccaggccgattgcgtcctggcccatgaaacgcatgcgcggcgccggtggatcgttgaagccgcgacgcacatccgccacatcgccgatacggaaggtgcggtcggccacccggatcgggaagttgctgatctgctcgacgctctggaaattaccggacacccgcaattgcaggcgctcgctgctggtctcgaaaaagccggcggtggacaccgcgttctgctcctccagggcctgctgcaccgccgccagcggcaggccgagggtcgccagcttgacgttcgacagctcgatccagaccttctcgtcctgcaagcccagcaggtcgaccttgcccacgtccttgacccgctgcagctggatctggatgcggtcggcgtaatccttgagcaccgcgtagtcgaaaccgtcgccggtcagcgcatagatattgccgaaggtggtgccaaactcatcgttgaagaacgggccctggatacccggcggcagggtatggcggatatcgctgatcttcttgcgcacctggtaccagagctccgggatctggttcgagtgcatcgagtcgcgcgccatgaaggtcacctgggactcgcccgggcgggaaaacgagacgatgcgctcgtactcgccggtttccatcagtttcttttcgatgcgttcggtgacctgccgggaaacctcctgggccgtggcgcccggccagttggtgcggatcaccatggccttgaaggtgaagggcgggtcttcgctctggcccagcttggtgtaggacaacgccccgacaatggccagcaacagcatcaggaacagcacgatctggcggttgcgcaacgcccattcggaaagattgaaacccatcggggattactccttggccgccagattgaccacgcggttggagcgatccaccgggcgcacctgctgcccctcatggagcacatgcacacccgccgccactacccagtcgctgaccccgaggccttcgagaaccggcacgctcttttcgccgaaggcgccaaggcgcaccggggtctttttcagggtgttgttggcgtcgacccgccagacataggcggcaccgttctccgcagtcaccgccgacagcggcaccgacaacggcacactggccgcggcctggataaacactcgggcgctctgccccagctcggccgggaccttgccggcagtaaaggcgatgcgggcggcgaaggtacgggagcgtgggtcggcggccggcgacagctcgcggatctgcccggcgaaacgctggtcgggctggctccacaactccaccgacaccggctggccaatgcggaaacggccaaaaccctgctccggcaggctgatcagcacttcccgctcgccgtcggtagccagggtaaagacggtctggccggcggcgaccacctggccgacctcgaccgtgcgccgggccacgacgccatcctggggcgcgcgcagcacggcgtaaccggcctggttgctggccacgtcgaactcggccttgatctgcttgagccgggccaggccggagcgatacaggttctcggcgttgtcgtactgggaacggctgaccagttgccgatccatcagggtcttgtagcggtcgcgctcggagcgcaccaggttcaggttggcctcggccgccgccacctgggcccgggtggcctccagttgcagccgcacgtcctgcgggtcgagctcggccaatggctggtcggctttcacccgctgcccctcatcgaccagtcgtcggctgaccttgcccccaatccggaacgccaggtccggttcgtaacgcgcgcggacctcgccggggtaactgtccatggcctgcgccgcgggctctggctgcaccaccatggccgggcgaacggtggtttgcgcggtttcttcatgtccgcacgcggacagcagaacggccaggctgacgggcaacgcgaggggtaaggcatagcggaacatggtgggggacctttcgctaagggtgcttcgaataattatactggcgggtatgttattaatagcaaactcaccagtccagtattaaagcgaagaatgtccgacaatctttccacctcaaacggccccggccgccccaaggacctggcaaaacgccaggccatcctcgaagccgcgaaaacgctgttcctgagcaatggctacgccaacaccagcatggacgcggtagccaccgaagccggtgtttccaagctgacggtgtacagccacttcaacgacaaggagaccctgttctccgccgcggtggcggccaagtgcgaagagcagttgccgacgctgatcttcgagttgccggccggcatgccgatcgaaagcgtgttgctgaacattggccggggctttcacctgctgatcaacagcgaagaatccctgaacctgcatcgcctgatcatggccctgggcagccaggacccgaagctctcgcagatcttcttcgaggccgggccgcaacgcatggtgcaaggcatggagcggctgctgaccagaatcgaccagagcggcgccctgcgcatcgacaagccgcgcaacgccgccgagcatttcttctgcctgctcaagggtacggcgaactttcgcctgctctacggctgcggcgagccgctgagcgacgaagccgccgaggagcatgtgcgggaagtggtggggttgttcatgcgggcgtatcggccggagtcggcctgaggtagtggcaacggagcgagcgggacgcccggtccctgctcgctatagacagccgaaaggcccgataaagatcaggccttgagcgccttcttcggatagatatcgtaacggctggatttgccatccagcgcatggctcggcttggggcctgcgatgcacggcgccttgcgcgggcgcttgaccaccacccggtggctggccagggccagggcggcctccagcagcgccggggcgtccgggtcgtccccgaccagcgggcggaacaggcgcatttcctttttcaccagcgcggtcttttcccgatgcgggaacatcgggtccaggtagatcacctggggcggctcgccctcccagttgcgcatgacctcgatcgagttgcccttgagcaggcgcatgcgcgccacgatcggcgccacctcgaaatcctctcccgcccgggccaggccgtcttccagcaaggcgccgatcaagggctggcgttcgatcaggctcatctcgcagccgaggctggccaggacgaacgcatccttgcccagccccgccgtggcatccaggatccgcggacgcacgccctgggcgatgcccaccgccttggcgatcatctgcccgctaccgccgccatacagccgccggtgcgccgcgcccccctcgacaaagtccacccgcaccggccctggcgcgtcggcgccgagctgctgcagctgcaagccctgctcgccgacctgcagggcgaactccgcctcgtcgatctgcaatggcagccccagtcgctcggcccagtgcgcggcctgcggctggaatgcatcggccaaagcctcgactttgatgcggcaggccgctggttgctcactcatctgaaaacacgctcaaaaaattaatgatcggcaaaaactgccgataaaagaactatccggcattttgccagagctgagcgtcgacccgagagaaatgtcagacattcgaagcctatccattggcgtcatatcgccccacggcgattacggcctaaaaaattcccaggcactgagcggcgtcagccatctgtggcaggatttttttgcccaggcgctggccgagcaacgcggcgatggcgcgaaggtcactgacgacaattctccggtggccgtggacggcccgaccgaaccccatggcggcagcgacctgctggcgcaaatcgttacccaacgtcattgcgacgtccaggacaccgagatccgtccaccggaaccgttgttcctaccgatcgccgagttcgagaccgagctgctggacaaaccgtttccgccgttcccgccggaagaaatcgccgcccagcaacaccagcaagacttcgaaagcggctgggtgcgccccatcgtcctcaatgccggccagcctgtgcccgagccgagcccggcgccgcagccgcggccattgcacctgccgatcgccgaattcgaaatggacctgctggacaaacccttcccgcccttcccgccgcaagagctcatcgagcaacagaagcagttcgacttcgataccggctgggcgcgtccgctgatcctgcagaacctgcggatcgccgcctaacctcaagccggtttcaccgacagatccactaccggcaatggcgcccagcggcaacccggccgctcaacccttgaacaaccgattgatctgcccgaacggcaaagcctggtcggcaaagtcgaagctgccgtggtcgcggatttcctgcgccgcctgatagaaggcgccataggcggcccgcgccagggccgaaccgacgctgatccgcttcacccccagctcgctcaactgcgccagggtcaatttcaggccgcccgacatcagcacgttgaccggtttgggcgccaccgcgcggaccacggcgatgatttcctcggccgagcgcaacccaggcgcatacagcacatcggcgccggcctcggcataggcttgcaggcggcgaagggtgtccggcaggtcctgccggccatgcagcaggttttccgcccgtgccgtgagcacaaagggaaaaggcaattgccgcactgcggcgaccgacgcctcgatacgctcgaccgccagtttgaagtcatagatcggatcatcggcccggcccgtggcgtcttcgatggagccgcccaccgccccgcaggcggccgcttggcgcagggtcctggcacagccttcggggctatcggaaaaaccgttctccaggtccaccgccaccggcaggctgctggcgccgactatggcgcgaacgttgcccagggtgtcctccagagacaaggcaccttcagcgtcggggcgccccagggaaaaagcgaaaccggcgctggtggtcgccagggcctcgaagccgaggctggccagcatcttggcggagcccgcgtcccaggggttgggaatcacgaaagcccgatcacgctcatgcagggccttgaaggtttgggcacgaagggtttgcgcatccattggcggactcctgggcagggaaatgatcccgctcagagcaagccgagttgctccgcggcgggctctctgtatagctcaggcaaggccggcaatccaggcaggcgctccatcaggcgcgcgtgaaaacgccgcgccagctcggcggccaggcggttatcggcggtgtgcaggaagatgtagggggttcgcccttcctcgatccagccggcgaccttgtcgatccagggcaccaggaacggatcgttggcctccagctccggatgaccgataaagcgcacctggggaaactgggtgaaggcggccgggcgcggcggtaccttgggtttcttcgattgcgcatggagcaccgacggctcgctggacgtgcaactgaacaaggcgcgcgggtcgaggcagatgcgctccaccccacgatccagcagcaggcggttgagcatgcgctcggcatcgcccttggcgaagaagtcccgatgccggacttccaccgccaacggccgctccaggccgtcgataaagcccgccagttccgccaggcgctgcggtgtgaagctcgcgggcagttgcagccacagcggcgaaacacgttcgcccagcgggctgagcaactgcaggaagctctcggccgcacccaattgttcgcgcaggtcaccgccatggctgatgtcgccgggaaacttggcggtgaagcggaaatgttcaggcatggtctgcgcccagcgctgcaccgtggcctccgcggggcgcgcatagaaggtggtattgccttccacggcattgaagacctggcaatacaggctgagaaagtccgtcggccgcgcgctttccgggtacaggtactcacgccaggcgttttcgctccaggaaggacaaccgaggtaataaggcagcaacatcagatgtgcaggtcgagacccaccacttccatatcccaatcgacgaaaccggcggtggtcaggtagctggccagggcgttggccacgcttcttttcatggcacggtggaagatcatgtcctgcggacgggcgggcaggttgctggtgcgcccggcggaggcctgggagcgcgcctgggctggagtctcgggctggacttcgacggcatctgcgtcctcgagggagtcgtccagcagcacgctgcctttgcgaggcttgcgcttgatggggtaggactgagaggaaatgccgtctatgcgcataatcacatgctcgatatcgatgatggcaatttagcggcacctcgccgactacgcaaatgcccgggtgataactagaacacagaaaatgcaaaaggtttaaaagccaccggaaactggcacgaaaacctgacgattgacacgctcgccacgcgggctcgtggtggcgaacagctctgcagcggcctgtcagcgcgcttttggcgtcgccactttgtcccgcaggtacaccggttgcgcctcgtccgccgggatcgcctcgccgcgttcccaggcaaagcgcgccagggtcagcaaatcttcggcgtggggcagcatgcccgcgtcctggccgctgagattgaccccgatacgctcggcgtagccccagccggtgcccgcgccgaaccagtcgccgctggcgtccgccggcaacgcagcggcttccggcggcagcaccgcttcggcccctgccaggcgcatctcgccggccacttcgcggtagcagccccagtagacctcatccattcgcgcatcgatggcggcggccacctgggtcgcgccgtgttcgcgcaatgcgcgctgcgccagcaccgccaggttcgacaccggcagcaccgggcgctccaaggcgaaggccaggccctggaccacgccgatggcgatccgcacaccggtaaaggccccaggcccgcgaccgaaggcaatggcatcgacggcctgcaggctggtgccggcatcggccagcagtttctggatcatcggcagcagcttctgtgcatgcaggcgcgggatcacctcgtagtggctcgtcaccttgccgttgtgcagcaaggcaaccgagcaggcttcagtcgcggtgtccagggccagcaaggtgctcatcgatgtttccataaggcagagggagttgaaaaaagtgacgcattataaacagcaacggcccgcaagcgggccgttgaagatcaagccggtacgactgatcagctcagcgcttcgagcaccttgccggtgatagactcgaccgaaccgacgcccgcgatgtggctgtacttcggcttgccctggctggcggccaggctctggtagaactccaccagcggcttggtctgggagtggtagaccgacaggcgatgacgcacggtttcttcggtgtcgtctttacgctggaccaggtcttcaccggtgatgtcgtctttaccggcgattttcggcggattgtagacagtgtggtaaacgcggcccgaggcctcatgcacacggcgaccggcgatacgctggacgatctcttcgtcgtcgacggcgatctcgaccacgttgtccagctcgacgccagctttgaccagcgcttcggcctgaggaatggtgcgtgggaagccgtcgaacaggaaacccttggcgcaatcggcctggctgatgcgttccttgaccaggttgatgatcaggtcatcggagaccagaccaccggcgtccatcacgctcttggccttcagacccagctcggtgccggccttgaccgctgcgcgcagcatgtcgccggtggagatttgcggaatgccgaacttttcggtgatgaactttgcctgagtacctttaccggccccgggagctcccagcagaattacgcgcatcgatgtgctcctcaattttttatttagaaacgctcggattcgcctcgtggggccaatctcggaaatgggatagtggccgcccaaacggccaaaggctgatcaagatacacagccgacacagcgcacacaagcagccgaaagtcggagcaacccgccgcctttatgccctggcgacagggtattgctggtcgcaaccccataacaaagtgtcgcctggcgacggtcgccagccctctcgggccagcgctcgaagtaccgtgccaagccactgaaaaccccggcaattaccttagccggtattgcgcaaaccggcggcaatccccgccacagacaccagtagcgcctgttccaccgggctgtcctgggcgccgtcctggcgtcgcgaacgggccagcagttcggcctgcaatagatgcagcgggtccaggtaggtattgcgcaggcgaatgaactccagggtgtcggggctatgtgccagtaactgcgactgaccggtcagccccaagaccaccgaacacgcctgcgacaataagtcgcgtaaatgcgcacccaatggcagcagcgccggctcgaccaatcgttcgtcgtaggaacgggcgatatccgcgtcggccttggccagcaccatctccagcatgtcgatgcgcgtgcggaaaaacggccactgttcgcgcatctgccccagcaactcgccctccccgcgctccagggccttgctcagggcggtttcccagcccagccaggccggcagcatcaggcgggtctgggtccagccgaaaatccacgggatggcccgcaggctttcgatgccgccagcgcgccgcttggccggccggctgcctaatggcaggcgccccagttcctgctccggcgtggactggcggaaatactcgacgaactgcgggttctcccgcaccaccgcgcgataggccttcaccccatcgtcggccagttcgtccatcaggtcgcgccaggccggttgcggcaggggcggcggcagcaaggtcgcttccagcaccgccgccaggtagagattgaggttctgctcggcgatgtccggcaggccgaatttgaaacgaatcatttccccttgctcggtggtgcggaagcgccccgccaccgaacccggcggctgcgacaggatcgccgcgtgggccgggccgccgccacgccccacggtgccaccgcgaccatggaacagcagcagctcgacctgctgctcgcggcagatatccaccagtttttcctgggcccggtactgcgcccaggcggcagcggtcgtgccggcatccttggccgagtcggaataaccgatcatcacttcctgcgggccctgcaggcgcgaacgatagcctggcagaagcagcaactgctcgatcaccgggccggcgttgtccaggtcggccagggtttcgaacagcggcaccacgcgcatcggccgcagcacgcccgcttccttgagcagcagttgcacggcgagcacatcggatgccgcgccggccatggagatcacataggaacccagcgaagccgccggggccgcggcgacttcccgacaggtcgccagcacttcggcggtatcggccgatggcttgaaataaccgggcaatagcggacggcgactgcccagttcgcgcatcaggaaatcgatgcgctcttgctcgctccagtcgccgtagcggcccagccccaggtaatcggtgatttcggtcatggccgcggtgtgccgcgaggagtcctggcgcacgtccaggcgtaccaggaacaggccgaaggtcactgcgcgtcgcaggcagtcgagcaacggaccgtcggcgatcacccccatgccgcactcatgcagggactgatagcagagttccagcgggtccagcagctcgcggttgttctgcagcacctgggcagtggccggcacgctaccgctcaacgaggcctgggcccagttgcgggtggcccgcaggcgctcgcgcaattgcttgagcaccgcgcgatacggctcggcgctgtcgccggccagggtccgcagcgccgcgttggcctgctgcatggacaggtcggccgccagttgatcgacatcgcgcaggtacaggtcggcggccatccagcgcgccagcaacagcacctcgcgggtcacctccgcggtgacattggggttgccgtcacggtcgccgcccatccacgaagcgaagcggatcggcgccgcctccagcggcaaatgcatgccggtggccgcgtgcaaagcctggtcggccttgcgtaaatagttggggatggcctgccacagcgaatgctcgatcaccgcgaagccccacttggcttcgtccaccggggtcggccgggtacggcggatttcttcggtatgccaggcctcggcgatcagccgctgcaagcgtgtctggatctgcgcacgctcggctgaagtgaggtcgcgatggtcctgggcggccaactgcgcggcgatggcatcgtatttctggatcagcgtgcggcgggcgacctcggtggggtgggcggtcagcaccaactcgatctccagccgtcccaactgccgggccagcgcctcggcgccatggccttcggcccgcaggcgcgccagcagttccggcagcacccgcgactcgaacggcgccggctgcgtctcctcgcgacggtgaatcaattggtactgctcggcgatgttggccaggttgaggaactggttgaatgcccgcgccaccggcagcaattcgtcctcgctgagttggttgaggctggcgctgagctcggcatccagcgaaccgcgccgatcggccttggcacccttgcgaatctgttcgatcttgtcgaggaaaccctcgccatactgttcacgaatggtgttgcccaacagctcacccagcaggtgaacatcttcgcgcaagcgcgcatcaatatcggtcatctacctgttctccagcggactcggggctcctggtaagccccaagagtgccgccagcacatggctattagcaagggcagtcttgacgcgaacagctgcgggcaacgccggtgcacgacgaagcgcctttaaaccttgcacgatggagctagtctcaagagtaagccgcacaacggcttagcgccggcacaggccggtcactcaccaagccctgccacaagcaggtgttcattgaggttgccatgaaaatccgtgagctcgcgcaacactgggaagaaaacgccaagggtcgcctgacccagaccggctacacgatctatctggatgtcgaagccgccgcacgcctggcggcaatttccgagatgtaccccaaacgccggaccgaggaactgctcggcgaactgatcggggccgccctggaggaactcgaaaccagcttcccttatgtccagggccagcatgtggtcgccaccgacgaagaaggcgatccactctacgaagacatcggtcctaccccgcgttttctcgccctgtcgcggcgttatctgcacgatctgtcggctcaggcagacgagcagaaacactgatccacgcctgcatttctcaccgataagagcgttattcctgaccccggatcgggtcaggagtacccctgcgcaccgcaaaagttccttatttagagccttgtccacacagtcaggaaatttccgggcaataagccatcttctctgaactattcaaaaaagcctcgggtcacagccaataaccatcactggaacggccgtttcattttcaacgccctcagccttgtcactcagcgttacggcgtcggaaccgggatggattttgatgtttttcaggagttatccaatggagttgaagaccatgaagatcagcactgccaaatcctcgtcaacctctctgcgcgggctgaaactggccgcgctggctctcggtagcagcctggtcctggccggttgcgccggtaatccgccaagcgagcaatacgcggtgacgcaatctgcggtcaacagcgcagtcagcgcaggcggtaccgaatttgccgcggtggaaatgaaatcggctcaggacaagctcaagcaagccgagctcgccatgcacgacaagaactatgacgaagcccggcgtctggccgagcaggccgaatgggacgcccgtgtcgccgagcgcaaggctcaggcagccaaggccgaacaggcattgaaggactctcagaaaggcgttcaggaactacgtcaggaaggcatgcgcagcgtgcaatgagccgcgagcgccgattcccacgtattcgcaatcgataaaaggacgaaaccattatgcgtaaacaactgatgatccctgccctgttggccctgagcgtagcgctgtcggcatgctccaccccacctaacgccaacctggaaaacgcccggaccaactactccgccctgcaggccaatccgcaggccaccaaggtagcggccctggaaaccaaggacgccagcgaatggctggacaaggccgacaaggcctacctgaacaaggaggacgaaaagaaggtcgaccaactggcctacctgaccaaccagcggattgaagtggccaagcagaccatcgccctgcgcaccgcggaaacccagctcaaggacgccggcgaccagcgcgccaaggcgcttctggatgcccgcgacgcgcagatcaagcaactgcaatcgagcctcaacgccaagcagaccgaccgcggtacgctggtgaccttcggtgacgtactgttcgccaccaacaaggccgacctgaaatccagcggcctggtcaacatcaacaagctggcgcagttcctgcgcgacaaccctgaccgcaaggtgattgtcgaaggctacaccgacagcaccggcagcgcggcttacaaccaatcgctgtccgagcgtcgcgccacttcggtacaggtcgccctgatcaagatgggtgtcgatccggcacgcgtcgtcgcccagggttatggcaaggaatatccggttgccgacaacggcagcgtgtccggacgcgccatgaaccgtcgcgtggaagtgaccatttccaacgacaaccagccggtcgcgccacgttcggccatcagcgccaactaagcccggccccgcgcgataaaccgcgcacccaataaaaagccccgccttgatcggcggggcttttttattgcggtaaccggatcgcggcttgcgctgggaggcctttcggtcactgctccagcttcggggtttcctggcccatgcagcgcacggcgcgcttcttgttgttgatcagcacgcccgtcaaccccttctgctcggtgtcgaacagcaccagcacgccatcgatgcattgcgccacttcggccgccggctccagggataccttgtagtcctcgccgggcacggtcttgagcatggtgaaatcgttgagcagcaacgcatcctccggcttggcgaaatgcaggtagccgtagtaccacaggcacgccacggtgccgaggatgctgcagataccggtgatgatcagggggatggcgttacgttcttcgctcattgcggactctctggaggttctacgactggattcaaaggtgtggggtaattggggatttcgcccaggcggcgcaggccgttgaaatgctgcgggtcctcaaggtaacgcaacatcacctggcgccagaccgggtcggcgaaggtctgcacatgaccgcctcgggtcagctgcagcaccctgggcgggggcgcagcttgatacagacggatgccgttggaaagcggtacgagggaatcgtcgatgctgtggtagatcagcttgggcacgccatccaggcgcgccatggccttgatcgcactgtcgccatcgggcaccagccacgacagcggcacctggaacggccaggtcatccaggacgtgctcagggcaaaacggcccacctcgcggtaactggccggtaccccgtcgaagacaatggccttgagctggcgctggcgttccggatgctgctccaccagatagtggatggccagggcgccgcccaggctctggcccaggacgatcagcggcttgccctggacctcgggcgcccggtccagccactggaaggccgcgtcgacgtcctggtagatcgccggcaggctcggtttgccttgcgacaccccgtagccacggtagtccaccagcagcacctgatagccctgctccggcaaccaccagctgccaccgaggtgcccggacaggttgccgccattgccgtgcaggtgcagcaccgtgcccttgaccggcaccccggccttggccggcagccaccagccgtgcaagcgcgtaccgtcggcggcggtcagggtgacgtcgcggtagtcgagccgggccttgtccggggtgaacggcaaaccgcgctcgggatagaacagcagcgagctgcaaccgctcagggtcagcagcaggcagacaatgctgaggactcgcatccgtttgaagccttatgccgagagtgaaaaacgccccctgcaggagcgagcttgctcgcgatacgtggtgtcaggcacatcgccatcacgagcaagctcactcctacagagagggggttacaggatgttcgagtaatccgcctcgatccggtccaggctcaggtgattgaggaagttggagaagcacatccaggccgacagcgcgttcatgtcgcggaactggtccggcagatacttgggcggcaccaccaggccttcgtcgaccaactggcgcagggtccgcatgtcctccagggtggtcttgccgcagaacagcaacggtatctgctcgagcttgcccttgcgcacggccaactgaatgtagttgtaaaccatgatgaagcccttgagataggacaagtctttggtgaatggcaggcccgtcggcaccgaaccgcggaacacccggctggcgttgccataactttcagccatttcgaaaccctgctcgcgaaagaacgcgaacacctgcatgaagtccgcgccctcctccaccatgtgaatggcgcgagtgcggttggtcagcttgcgcagacggctcgggtaggaagcgaaggtaatgatctccatcaggatcgccaggccttcctgggtcacggtcgacgagggtgggcccttggacaggaaggtgcagatcggctggttcaggccgttgagggtagtgcccacgtggaccaagccttcgtggacttccagggcgcgcacatcgcgatcgttgaacagcgcgtcggcgcggatcttgatgtagtcggcgccggccgccgcgtcggcgactatgccatcggactcgaagacccggatggtttcctcggcctcgccgaacaccttgttcagccggctttgcagcaggttcaccgcttccttggcgctcagggtcttgggttcgtccttgagatcgccacggccgtcgatattgttcaggtaatccgagagcatcaggcccaggtcggccagggtcgggtcgccggcatgaaaggcgtcggaggccgcgccgtagagctcctgggatatcagcccgaagtcctcggtgccacgggcctcgagcatccgcaccaccatgcggtactccttgcacatgcgccgcatgatctgccccaccgggttgaactggcccagttgccgggtgatgtcacgctcgatgttctggaactccagcttcaccgcgctggagtcgaaagacagcggccggccttcgtaataggcgcggtccaccgccggcatttccttgccattggccttgaggaaacctttgcggatgttgtcatcccacttcaccgcatccagtacgcggatcggcgtctgtgccagcacaatgcgatcggacaaggtgcgtatcgtctgctggtaatcgtccaccccaaaactcccgttaaaacgtctgtactgcgtttacttgcctgcccgctggaagcgcgccgcctcgacgaacacgtcagagttggcgggatcgtccagataggcgaaaacctgtgacagcgcgctgtcgatcagcacgccctcgccgtccttggtgtcgaacggttcgccccgcagggcgttctgcccgcgggcctgattgatctgctcgagatcgagctggtagagcaccagctcgtgttcgtcggtcaactcgaaaccggcgatggtgaaatgcccaccgagcgcctggggcaccgccgccgagagataccagcggctgccgtggcgggaaacggtgaactcgtaagtatcgtgctgctgcggcttggccttgacggaagtgacggccttgtagcggttgttgccgatgcggctcagttgcagggtgagcggttcgccccaggcattcttgctggtccatttaccgagcaacgccgcgggcgccgcctgatcggccggcaaaggctccgtgaaggacaccaggcagccactgagcagcaggaacgacaaggcgatcacaacgcgccaggctttcattcaacactccctatcagcagtcgccccgtagccgctagcgcagcctgcgttcgggcgggcggatcacaccgaggccaataccaggtgcatgtaccgggtcagaatacccagcatgtcctcgtcggccagaggctctgccccgttgagcaggccctgatattccatccgtccgattatagacgtcaacactttggcatcctgttgcggctcgcgggaacccaatacctggaaaaactggcaggtgccctgcagcaggatctgctggtgggaacgtaccagcagcgccaggcgcgggttaagcagcgcttcttggcgaaacgcctgctcggccattagatgctcgcggcggttgtgcagttggcgctgcacgtaatcggcggtcaggcgggcaatgtcatcggccagttgcgcgcgggactccgggctgccgtcgccataggcgaccatctcccgcagcaagccctcgttgttggcccacagcttggccatgaaggcggcgctgcgctcgacgtattgggcgaaggtatcggtgagcaggtcatcgatatccttgaagtagtaggtggtggccgacagcggcacaccggcttcggcggcgaccgcacgatggcgcacggcgcgcacgccatcgcgcacgacgatgcgcatggcagcatcgagaatatcctggcgacgttgctcactgccctgtcggctggccttgcgaccctggtactgaacactttcagcgaccgcagtggcgatgccagctgcaccttcttgagcaattgcacggttcacgacaggtattcctctcacataaaaaatgaaaaaagcagtacgtcagtgccacacagacaataaaaagccgcctgttagcggcggctttttattcaacatatttacgcttgcggccgcatgtgcgggaacaggatcacgtcgcggatcgacggggagttggtcagcagcatcaccaggcggtcgatgccgataccttcaccggcggtcggcggcatgccgtactccagggcgcgaacgaagtcggcatcgtagtgcatggcttcgtcgtcaccggcgtccttgtcggccacctgggccatgaaacgctcggcctggtcttccgcgtcgttcaactcggagtaggcgttggcgatttcgcggccaccgatgaacagctcgaaacggtcggtcacgttcgggttctcgtcgttacgacgggccagcggcgagacttcgaacgggtactgggtgatgaagtgcggctgctccagcttgtgctcgaccagttcttcgaaaatcatcacctgcagcttgcccaggccttcgaagccgaggaccttggcgccggccttcttggcgatggcgcgagccttgtcgatgtcgttcaggtcatcggcggtcagctcagggttgtacttgaggatcgagtcgaacaccgacaggcgggcgaacggctcgccgaagtggaacaccttgtcgccgtacggcacgtcggtgctgcccaggaccagctgcgccagttcgcggaacagttcttcggtcaagtccatgttgtcttcgtagtcggcgtaggcctggtagaactccaacatggtgaattcagggttgtgccgggtcgaaacgccttcgttgcggaagttgcggttgatctcgaacactttctcgaagccaccgaccaccaggcgcttgaggtacagctccggcgcgatacgcaggaacatttccatgtccagggcgttgtggtgggtctcgaacggcttggccgccgcaccgccgggaatggtctgcagcatcggcgtttccacttccaggaagtcacgcttcatcaggaagctgcggatatgggcgatgacttgcgaacgcacgcggaaggtttcgcgtacgtcttcgttgacgatcaggtcgacatagcgctggcgatagcgctgctcggtatcggtcaggccgtggtgcttgtccggcagcggacgcagcgacttggtcagcaggcgtacctgggtcatctcgacgtacaggtcgcccttgccggaacgggccagggtgccttcggcggcgatgatgtcgcccaggtcccaggtcttgaccgcatccagggtttcttccggcagggtcttgcggttgacgtagacctggatccgcccggtcatgtcctggatcaccatgaacgagccacggttgagcatgatgcgaccggcaaccttgaccgggattgcagcctcggccagctcttccttggtcttgtccgcgtattgcttctgcaggtcgttgcagtagttgtcgcggcggaagtcgttcgggaaggcattgcccttggcgcgctcggcagcaagcttttccttgcgcagggcgatcagggtgttttcttcctgttgcagggcctggtcgagttgtaggtcgctcatgtctttaaattttccatcacaggtacgttgccccttgcctgtggcaagggatcgcgggccagcctcgctcctacagaagcgcgccgtgcccgcggcatgggtgtcgcggcttacagccccgatttcaggctggccaccaggtattcgtcgatgtcgccgtcgagcaccttgtcgcagtcactgcgttcgatgttggtacgcagatccttgatccgcgaggcatcgagcacgtaggagcggatctggtgaccccagccgatgtcggacttggtgtcttccagcgcctgggaagcggcgttgcgcttctgcatttcctgctcgtacaacttggcccgcagcatcttcatggcggtgtccttgttggcgtgctgggaacgttcgttctggcagctgaccacggtgttggtcggtacgtgggtgatacgtacggccgagtcggtggtgtttacgtgctggccaccggcaccggaggaacgataggtgtcgatgcgcaggtccgccgggttgatctcgatttccaccttgtcgtcgatctcgggcgagacgaatacggccgagaacgaggtgtggcggcgggcgccggagtcgaacgggctcttgcgcaccaggcggtgcacgccgatctcggtgcgcagccagccaaaggcgtactcgcccttgatgtgcacggtggcgcccttgatcccggcgacttcgccttcggacagttccatgatggtggcgtcgaagccacgcttggaggcccagcgcaggtacatgcgcagcaggatgttggcccagtcctgggcttcagtgccgccggagccggcctggatgtccaggtaggcgttgttcatgtccatttcgccgctgaacatgcgacggaattccagcttggccagggcctcgtcgagacgggtcagttcggcgaccacatcgcctaccgcgccttcgtcgttctcttcgacggccatgtccagcagatcgcggcaatcggccaggccaccggacaactcgtccagggtctcgacgatctgtgccagcgcggagcgctcgcgccccagttcctgggcgtattcaggcttgttccagacgttcggatcttcaagctcgcggttgacctcggtcagacgctcatgcttttgatcgtagtcaaagatacccccgaatagtttcggagcgctcggacaggtccttgatagtgttaaggatcgggttgatttccatggcaggcagcactcgttggcgaacttttgaaagccggcgagtataacgtaatcaagctggtgcggcagcccgcctggcggctttaggcccccgcggtggcggtttttttcactcgatccccacctgattgcgaccattgtgcttggccagatacaggcctttgtcggcggccgagatcaattgccggcaactggtgctcggctgcggcgtcatggtggacagaccgatgctgatggtcaggctcgccccttcggtcggcgcgatatgcggaatcttcagtgcggccacggtctggcgcagtttctcggccaccagccgcgccccgccgggcgaggtgttcggcagcaccagggcaaactcctccccgccataacgcgccggcagatccgacggtcggctgctggcttcgcggatcgccgtcgccaccttgcgcagggcttcatcgccttccagatgaccgaagttgtcgttgtaggacttgaagtaatcgacatcgatcatcagcagcgacaactgggtctgatcgcgcattgcccggcgccattccagctccaggtactcgtcgaaatgccggcgattggacaggccggtcaggccatcggagttcatcaggcgctgcagcaccaggttggtatcgagcagctgctgctggctgacccgcaacgcgcgataggccgcgtcccgctgcaacagggtcatgtaggaacgcgagtggtaacggatgcgcgccaccagctcgatattgtccggcagcttgaccaggtaatcgttggccccggcggcgaaggccgcactcttgatcagcgggtcttccttggtcgaaagcacgatgatcggaatgttctgggtcgccgggtggttgcggtactcgcgcaccagcgtcaacccgtccaggcccggcatcaccaggtcctgcaggatcaccgtcggcttgatgcggatcgcctgggcaatggcctggtgcgggtcggcacaaaagtggaagtcgatgttttcttcattcgccaacccacgccgcacagcctcaccgatcattgcctggtcgtcgaccagcagcaccatcgcagcattttcatcggttttaaaatcgtcgagctgtaaatcattcatgggttgtcacctgagttgctacctggccaggacagctgcgtttgtcggtcatttggcaaatatctccagcaatcgtggagcgatcttgtccagtgggcgaatctctacggcagcgtcgatggcagcggccgccttgggcatgccatacaccgcactactattctggtcctgggcgatggtcaggtaaccctggtcgcgcatcagtttcaggccctgggcgccgtcgcggcccatgcccgtcagcagtacgccgaccgcatcgccgttccagtaattggcgacactttcaaaaaacacatcgatcgatggccgatagatctcgtttaccggctcggcggtgtaggccagggtgccgttcttcaacagccggatatggtggttggtcccggccagcagcaccgtaccgctctgcggtggctcgccttcgcgggccaggcgcaccttgagcccggaggcgctgctgagccattcggccatgcccgcggcgaacacctggtcgacatgctgcaccaacacgatggcggccgggaaatgggcgggcagccccttgagcaacacttccagcgccgccgggccaccggcggacgaaccgatcgccaccaggccctggcgttgcgccatggtgcgcatcggcaccggtaccgaacgcacgcggttgccgcgctgctggccgatcagccagccgatattgaggatcttgcgcagtaaaggcgccgccgcttcctgcgcattgccggcccccagggccggtgtatcgaccacgtccagcgcgccatgccccatggcctcgaacactcgatgcacgttctgctggcggtccaccgtgacgatcacgatagcgcaaggggtttcggccatgatccggcgggtcgcctccacgccgtccatcaccggcatgatcaggtccatcaggatcaggtcgggcgtcagctgagcgcagtactcgaccgcctcggcgccattggtcgcgacccacaccacttcgtgcgcgggttcgaaggccagggcccggcgcagggcctccacggccatgggcatgtcattgacgatcgcgattttcatgcccgcgctcctccaatcagctccaccaccgcatccagcagggcgtcatcatggaaactggctttggctagataatagtcggccccggcatccagtccacggcgccggtcctcttcacgatccttgtaggaaaccaccatcaccggcaacgactgcaggcgattgtcacggcgcaggagtgtgaccaattcaatcccatccattcggggcatatcgatatcagtgatcagcaggtcgaagtcttccgaacgcaaggcgttccagccatccatgccgtcgacggcgaccgctacgtcataaccacggttgagtaaaagcttgcgttgcagctcacgcacggtgagcgagtcgtcgaccaccagaatgctcttgcgcgccgtctcggcctgatggcgattgtgccgggcgatgcgttccaggcggccggtattgagcagcttgtccaccgaacgcagcatgtcctcgacgtcgacgatcagcaccaccgagccgtcatcgagcaaggccccggcggaaatgtcctggaccttgcccaggcggtcgtccaggggcagcaccaccagggtccgctcgccgatgaaacgctcgaccgccacgccgtagaccgcgtcgcgctcgcgaatcaccacgaccttgagcgtggactcattgttctgccccgccgggcgttgcagcaactggctggccgcgaccaggccgacgtggcggccttcgtgccagaaatgctggcgcccttccagctgaacaatgtcgtcgggctccagatcgcacatgcgttcgatatgcgccagcgggaaggcataggcctcttcgccgacctccaccaccaggctgcgcaccaccgacagggtcagcggcacttcgaggtggaaacgactgccctgccccgccacctgctccaactgcaccgcgccgcgcaactggcgcaccatgtgttgcaccgcgtccaggccgacaccgcgcccggacacctcggtgaccttgtcccgcaggctgaaacccggcaggaacaggaaggtcagcagctcttcttcgctcagctgggcagcggtctcggcgggggacaactggcgctcgacgatgctctggcgcacccgttccaggtcgacgccattgccgtcatcgctcagctccagcaccagcagcccggcctggtgggaagcgcgcaggcgaatcaggccctcggccggcttgcccgccagcagccgctgttcgggcgtttcgataccgtgatcgaccgcgttgcgcagcaggtgggtcagcggcgcctcgagtttttccagcacatcgcgatcgacctgggtcttctcgccctcgacctccaggcgaacctgcttgcccaggctgcgccccaggtcgcgaaccatccgcacctggcccaccagcacatcggcgaacggccgcatgcgacaggccagcgcggtgtcatagagcacctgggcacgctggctggcctgccagccgaattcatccagctcggcggttttctccgtcagcacctgctgggactccgccagcaggcgtcgcgcatcttccagggcttctagggcctccaggcccagcacctgctccttgagatgcccattgaggttttccaaagcgcgcaggccgttgctctgcaggcgcttgaggcgctgcagagccgccaggtacggcttcaggcgctgggtttccaccagcgatttgctcgacaggtcgagcaggctgttcaggcgttcggccgtgacccgcaacacccgttcgcccccctcggcgagcttcttgcccttgtgcgtaatcgccgcggctgtctcttgcagcgtttcctgcaatacctcctgcggcatctcgaacggcgggacctgtggttcgggttcgacccgcggagcctgcatttgcagctcggccatgggcggcaggttcggctcgatccggggcaggacaacgcccgcaggcgccgcgcccggcgagccgaccaactgctccatgagcgccacgtaggcggcaatgtcctgctcactgacctcgctgcccggcgtggcgatacgcatcaggaaatcggtgccctgcagcagcgcatcgatatgttcgggacgcaggtacagccgcccttcctgggcgctgaccaggcaatcttccatcacatgggccacgctgaccccggcgtcgaccccgacgatccgcgccgcgcccttgagcgagtgggcggcgcgcatgcaggcttccagctggtcggcctgggtcggattgcgctccagcgccagcaggccggcactgagcacctgggtctgggcttcggcttccaggctgaagagttcgagcagcgaggcgtcgcgcatttgatcgggggtcatgtcaggctccgggtcacggcggacagcaactgctcttcatccagccaacgcaggctgcggcccttccattgcaggacgccacgggtgtacttggcactggcctgctggccggaaaccgcggcggcgtccagggtgcgctcgtcgatggcatggatgccctccacctcgtccaccggcaccaccaccgggccgccctgggcggcgatgatcaacatccgcggaatcacccgcgcccccgacacgaccgtgctggtggtgtccagccccagcaactccaccaacgacaggcacgccaccagcgcaccacgcacattcgccacgcccagcaaggcccgcgagcgctggtgcggcaaggaatggatcggctgcagcggcgccacttccaccaggcaacgggtggcaatgcccagccattcctcgcccaggcggaacatcagtaacgaacgggtgacgacatccgtatcggccgcgaccgcttgctcatggcgctcctgctgcaacgcatagcggtcgagcaggcgggtggccgcggcggaatacaccgagcaattgcggcaatgcacatgcccggccagcaacgggcaactcttgtcgccgtggataccgatacggttccagcaatcgtcgatggcctgcgcatcttcgtgggtcacgttcaacgaaacagagccgctcatgatttacgctcactgtctgctgcacggccgctgcgggccgcgcgctcctgcaatcggcgggcaccggcgacgtctccctgggaggccagcaaggcggccagatgcgccagcgcttcggcgtgctgcgggtccaggtacaaggccttgcgatagaagccctgggcttccagggcgctgcccgccacgtcgctgagcagccccagccaatagaacacctgcgccaccggctcgtgggtgtccaggtaatgctcgcaagccacccgggcctcggcgcttttgccttcgttggccagggccgcgatgctcgccagcaacgtcgtggcatcgctggccggcctggtcggcgcagggcgctggctcgccaccgcactggaaaacggccggctgcgcaccggcggcgcgatgccgcgcaccggctggcgcgctggcaatgcgctcggtacgaaggccggtgccggcgtgggctcgggttcgttatgccggctgaaggcaaaggactgggcaatgccgatcgagcgcatgcccaggcggcccagcaggctgccttcggccgggccgatgaacagcacgccgtcgacatgcgtcaggcgcttgagcacttcgaacacctggcgctgggtcggctgatcgaaatagatcagcaggttgcgacagaagacaaaatcgtagggcggctcattggccagcaaggtcgggtccagcaggttgccgacctgcaggcgcacctgctcgcgcacccgctcgctgaggctgtagcgctcatcttcggcggtgaaatgccgttcgcgaaaatcgctgtgctggccacgaaaggagttcttgccgtacaccgccagcctggcccgctcgaccgacagcgggctgacatcgaagccatcgaccttgaattgatggggagcgagcccggcatcgaacagggccatggcaatcgagtacggctcctcgccggtggaacacggcaggctgaggatgcgcaaggcgcgcatgcccttgagttcggcaagccgcgagcgcgcgagtttggccagggtcgtaaaggattccgggtaacggaaaaaccaggtttccggaacgatcaccgcttcgatcagggcctgctgttcatcccgcgagccttgcagggtctgccagtaatggtcggcgctgagcgcctgctgggcgatgctgcgctggcgcaccgcgcgctcgatgatcgccgggcccaccgaagccacatcgaggccgatgcgctccttgagaaaatcgaaaaatcgctggtcgctgctcatgacggctccccgagcaacgccggatccagcggcggcgagggaaacagcagcgcacgcacctcggcatccagcagatcgtcgacacgcacccattgcagcaggccctgggcgtcttcgtagaccgggcccaggtacggcgcattgcggttatccaggccgtaggccttgaagtcctgcgggttgcaacgcagggtgtcagtggcctgctcgaggatcagccccagcaactgcgcgggctgcgccgcctgcgggcggtaatgcaccagcaccaggcgggtgctggtgcgctcctgcgccggctggccaaaggtcagggcactcaggtcgagcaccggcaccaccgcgccgcgatgggcgaagactccggccacccaggacggcgcccggggaatcggcttgagttgcaggcgcggcaatacctcgaccacctcgacggcctgcaaggcgtaacgttcggtgccgatgcggaacactaggaacagcgtgtctttcgtcgccgtccccgcgccgcctttcgctgcgagctcgttcatcagactttgaaacgcgagacgccgctgcgcagccccaccgccacctggctcagttcatcgatggcgaaactggcctggcgcagcgactcgacggtctggctgctggcatcgcccagttgcaccagggcgtggttgatctgctcggcaccggtggcctgggcctgcatgccctcgttgaccatcaacacccgcggcgccagggcctggacctggtggatgatctgcgacagctgctcgccaacctgctgcacctcggccatgccgcggcgcacttcttcggagaacttgtccatgcccatgaccccggccgagaccgccgactggatctcccggaccatttgctcgatatcgtaggtggcgaccgcggtctggtccgccaggcgccgcacttcagtggccaccacggaaaagccgcgcccgtactcgccggctttctcggcttcgatcgcggcgttgagcgacagcaggttggtctggtcggcgaccttgacgatggtcaccaccacctggttgatgttgccggccttctcattgaggatcgccagcttggcgttgaccaggtcggccgcgcccatcaccgaatgcatggtttcttccatgcgcgccaggccttgctggccggaaccggccagcaccgatgcctggtcggcggcggtggagacttcggtcatggtgcgcaccagatcgcgagaggtggccgcgatttcccgggaggtcgcaccgatttcggtggtggtcgccgcggtctcggtggcggtcgcctgttgctgcttggaggtggcggcgatctcggtgaccgaggtggtgacctggaccgaggagcgctgcgcctgggacaccagggagttgagctcggtcatcatgtcgttgaagccggtttccacggcgccgaattcgtccttgcgctccaggttcagacggctggtcagatcgcccgtgcgcatgacgtcgaggattttcacgatacggttcatcggcgccatgatcgcgcgcatcagcaacaggccgcacaggcccgccgccagcaccgccaccagcagggaaacgcccatggtgactttggccgcggccaccgcatcgtcgatctgcgaggaggccgaatcggcgacccccttgttctcgtcgatgatgtcgttgagctttatccggccagccacccaggtcggggtcagctgttcattgaacaggcgcaccgcctcgtcttccttgttttgcacatgcaggtcgaggacggcggcctggatcttgatgaattcctggtgctgtttctcgaacgcctcgaattcgctctggtcctggcgggtggtgatggtgtttttatagctgctcaggtgttgctgcaggcgctgctcgaagttcttgaagtccgccgcatcctgggaactgatgccctggccttccttcaagccgatgatttcctgggtgtgcaggtagctgtcaacccaggcgccgcggaccatcgaactgaaatagaccccgggaatggcatcggagcgcatgcggtcttcgccggcctcgatcttcaacaaacgggagtacgaggctatgaccatcagcagcatgatggtgataatcaccgcaaagctcgccaaaatgcgttggcgcaacgtccagttcttcacagtcagtcctcggggccattcaaatggtggggagtatagccgagggcgtgccatcatttatcagcgtattgcgcaccacgtctcactcagagcgaaaggcagggtccgctctggagggctactttccgccagatgactcgagtgccgccagtgatgatccggcataagcagagggtatttcagccatcaaagagggcgtgcgaagctttctccagcgcacgcccgattggcgtcaaagattggcctggcgcacctgtttttccagttcgagtttcaaccccggctccagcttgagttgacgcgccagctcatccagataggccttttccatgaagttttcctcgtccaccagcatcacgctggcgacgtacatttcggcggccatttccggggtgccggcagcacgcgccacatccgccgggtccaagggtttgttgagttcggcgtgcagccagtgctgcagttcctgatcgttgtccagccgggtgaactcaccttcgatcagggcgcgctcgcgctcgtcgatatggccatcggccttggccgcggccaccagcgccttgaggatcgcctggctgtgctgttcgacctgttgcgcaggcaagcggtcgagggtctgcggctcgctttgcggcgcgccggcctgctgcgcctgccagttgccgtaggccttgtaggcgatcacgcccagcgccgccaggccgccataggtcagcgccttgccgccgaatttgcgggcttttttattgcccagcagcaggcccatggcgccggccgccaacgccccgccgccagcgccggacaacaggctgccgagcccgccggaaccgccaccgagcaacccgcccagcgcgcccttgtcggcagcggatgccttgttctgctgcgccccggccttgttctgcaacaggtcctggccagacttgagcaattgatcgagcaatccacgggtgttcatccaaacctccagcaacttgagttgatcgaatcaataaggccatcagcctagatcgaagtgccccgcgcctgggctcgagtgtgcttccagatgttgcttcgccaggctcgctcgcatgcctgggcagcccttcgattaaaaagatatacactcgaaaaaatcgataaaaccgcctgaccggtgatgcccatgatgaccttgcgccagatccgtcacttcatcgccgtggccgagaccggctcgatctcgtccgcagcccaggcggtgttcatttcccagtcgaccctgaccctggcgatccagcagctcgaacaggaaatcggcgtcagcctgttcaaccgccacgccaagggcatgaccctgactcaccagggccaccagttcctgcgccaggcgcacctgatcctggccaccgtcgacaacgccaagcgcagcctgcaacagagcaccgaccaggtggccggccagttgatcgtcggcgtcaccagcctggtcgccggttactacctggcggacttgctcacgcgtttccagcgcgcctaccccaatgtggaaatccgcgtgatggaggatgagcgtccctacatcgagcacttgctggtcagcggtgagatcgacatcggggtgttgatcctctccaatctcgaggaccgccacgccctgcagaccgaagtgctgacccactccccccaccgcctgtggctgcccgcccagcacccgctactggaacacgacagcatcggcctggcggatgtcgctcgcgagccgctgatccagctcaacgtcgatgaaatggaccgcaatgcccagcgcctgtggtccggcgccggcctgcaaccgcgcatcagcttgcgcaccgcctccaccgaagcggtgcgcagcctggtggcggccgggcttggggtatcgatccagccggacatgacctatcgcccctggtcgctggagggcgacatcatcgaggcccggcccatcgccgacctcagccagaccctcgatgtcggcctggcctggcgccggggcacagcgcgcccggcgctggtcgacccgttcctgactgtggctcgtgaacagccccacggcgggcgcaagccatctatttaatcgaacgctgcattcagtatttggtatttgtcgagcaccggccccgccactagtctctgatcatccgtccagagagggccgggcctccgtcactggagagcaccatggccataccagaaaagagaacccggaaaatggctggcgcgcagactccgttgtccaccgctttgttgatcgatggcgaattggtcgccggccaggggcttgtcgaacctatcctcaacccggccaccggcgaagtgctgacccggatcgccgaggccagcagcgaacaggtggaaggcgcgatcctcgccgcccaccgcgcctttaccgactggtcgcgcaccacgccccagcaacgctcgaacatcctcctggcgattgccgatgccgtggaaaagcaggccgaccacctggcccgcctggaatcgctgaactgcggcaagccgctgcacctggcgcgccaggacgatctgggcgccaccgtcgacgtattccgttttttcgccggcgccgtgcgctgccagaccggccagctcgccggcgagtacctgccgggctataccagcatggtgcggcgcgaccctatcggcgtggtggcgtccatcgcgccgtggaactacccgatcatgatggccgcctggaagatcgccccggccctggccgccggcaataccctggtgttcaagccgtcggagcataccccgctgtcgatcctggccctggcgccaaccctggccgaactgctgccgcgcggcgtgctgaacattgtctgcggcggtggcgaaggcgtcggcagccacctggtcagccaccccaaggtgcgcatggtgtcgctgaccggcgatatcgtcaccgggcagaagatcctccaggccgcctcgaaaaccctgaagcgcacgcacctggaactgggcggcaaggccccggtgatcgtctgcaacgacgccgacctgcaggccgtggtcgagggcgtgcgcaactacggctattacaacgccgggcaggactgcaccgcggcctgccggatctatgcccagggcgggatccatgaccgtctggtggccgaactgggcgccgccgtgagcagcctgcggttcgccggcaagcgcgatgccgacaacgagatcggcccgctgatcagcactcgccagcgcgaccgcgtggccagcttcgtcgaacgcgccctgggccagccgcatatcgaacgggtgaccggcgcggcggtgcattcgggcgccggcttctattaccagccgaccctgctggccggctgccgacagcaggatgaaatcgtccagcgcgaagtgttcggcccggtggtcaccgtcacccgtttcgacgagctggcgcaggcggtggactgggccaacgactcggaatacggcctggcctcgtcggtctggacccagaacctggacaaggccatgcaggtggcagcacgcctgcaatacggctgcacctggatcaacagccatttcatgctggccagcgaaatgccccacggcggcttgaaacgctccggctacggcaaggacctgtccagcgattcgctgcaggactacagcgtggtgcgccacatcatggcccgccacggcaatgacctggaataacggcactaagctgataacaagccccttagggcgcgctccatcacgttcacaactgccccgaccataatttgaagaagagggtttccccatgttcgtgcacaagaccgcactgctcagtgcaatcaccaccgccctgctggccagcgccagcctccaggccgccgaaccgctcaaggccgtcggtgccggcgaaggccagctggatatcgtggcctggcccggctacatcgaacgtggcgagagcgacaagaactacgactgggtcaccggcttcgagaaggagaccggttgcaaggtcaacgtcaagaccgcgggcacctccgacgagatggtcagcctgatggccaagggcggctacgacctggtcaccgcgtccggcgacgcctccctgcggctgatcgtcggcaagcgcgtgcagccaatcaacaccgcgctgattcccaactggaaaaacctcgacccacgcctcaaggacgcgccctggtacgtggtcgacaagcagacctacggcacgccctaccagtggggcccgaacgtgctgatgtacaacaccaccgtcttcaagcaggcaccgaccagctggagcgtgctgttcgacgcgcagaacctgccggacggcaagcccaacaagggccgcgtgcaggcctatgacgggccgatctacatcgccgatgccgcgctgtacctcaagagcgcgaaaccggaactggggatccagaacccctacgaactgaccgaggcccagtacaaggcggtgctcgacctgctgcgcgcccagcagccgctgatccaccgctactggcacgacaccacggtacagatgagcgacttcaagaacgaaggcgtggtcgccgccagctcctggccgtatcaggtcaacggcctgatcaacgagaaacagccgatcgcctcgaccattcccaaggaaggggccaccggttgggccgacaccaccatgctgcacagcgaggccaagcaccccaactgtgcctacaagtggatggactggtcgctcacgccgaaggtccagggcgacgtcgccgcctggttcggctcgctgccagccgtgccggcggcctgccaggaaagccaactgctgggcgccgagggctgcaagaccaacggcttcgaccagttcgacaagatcgccttctggaaaaccccgcaggccgagggcggcaagttcgtgccgtacagccgctggacccaggattacatcgcaatcatgggcggcaggtgagttccctgtagccgctgccgcaggctgcgcaaggtccgcaggaccttctgccccctcaagatcgccgcgcccctgcggggcgatcgcagccttcggcagcggctacaggttcctgcgtcgggccggctccagcaggagcggcctacgccgccagacctgatctcgcttatttcgacagcgcgctttcccggagcaccgcaccatgacgcttgcagtccagttcaccaacgtttcccggcagttcggcgaggtgaaggccgtcgaccgggtgtccatcgatatccaggacggcgagttcttttccatgctcggcccttccggttcgggcaagaccacctgcctgcgcctgatcgccggtttcgaacagccgagcgccggctcgatccacatccacggggccgaagccaccgggttgccgccctaccagcgcgacgtcaacaccgtgttccaggattacgcgctgtttccccatatgaacgtgcgcgacaacgtggcctacggcctgaaagtcaaaggcgtcgccaaggccgagcgcctcaagcgcgccgaagaagccctggccatggtcgccctgcaaggctacggcgaacgcaagccggtgcagctgtccggcggccagcgccagcgcgtggccctggcccgggcgctggtcaatcggccgcgggtcctgctgctggacgagcccctgggggcgctggacctgaagctgcgcgaacagatgcagggcgaactgaagaagctgcagcgccagctcggcatcaccttcatttttgtcacccacgaccagaccgaagccctgtcgatgtccgaccgcgtggcggtgttcaacaagggccgcatcgagcaggtcgacagcccgcgcaacctgtacatgaagccggccaccaccttcgtcgccgagttcgtcggcacctccaacgtgattcgcggcgagctggccgaacgcctgagcggcagccagcggcccttctcgatccgcccggaacatgtgcgtttcgccgaaggcccgctgcccagccacgagatcgaagtcagcggcctgctgcacgatatccagtaccagggcagcgccacccgctacgagttgcaactggacaacggccagaccctcagcatcagccgggccaacgaccaatggctggacagcggcgcccagcaccagaccgggcaacgcctcagcgcgcgctgggcccgcgccgcgatgatcccactggccgataccctggcgagcggggtgtgacatgagcaccctggcgatcacttcccaaagccccggcggctcgccgctgcggcgcttttccaacctgctgtaccggcggccgaacctgtacctggcgctgctgctggtgccgccgctgctctggttcggcgcgatttacctgggctccttgctgatcctgctctggcagggcttctacaccttcgacgacttcaccatggcggtcaccccggacctgaccctggccaacttcgccgcgctgttccagccgtcgaacttcgacatcatcctgcgcaccctgagcatggccatcgccgtatcgctcgccagcgccgtggtcgccttccccatcgcctactac

(The sequence listing continues in the following parts.)

The invention claimed is:

1. A method of controlling or treating potato late blight disease in plants, the method comprising:

formulating a bacterial culture into a biopesticidal formulation; and applying an effective amount of the biopesticidal formulation to a plant, or part thereof, infected by, or at risk of infection by, *Phytophthora infestans;* wherein the bacterial culture comprises an effective amount of one or more bacteria selected from the group consisting of:

*Pseudomonas chlororaphis* strain 189, International Depositary Authority of Canada accession number 151116-02;

*Bacillus subtilis* strain WAUSV36, International Depositary Authority of Canada accession number 151116-01;

*Pseudomonas fluorescens* strain UWO1, International Depositary Authority of Canada accession number 151116-03;

*Pseudomonas fluorescens* strain KENGFT3, International Depositary Authority of Canada accession number 151116-05;

*Arthrobacter* sp. strain OY3WO11, International Depositary Authority of Canada accession number 151116-04; and

*Pantoea* sp. strain OXWO6B1, International Depositary Authority of Canada accession number 151116-06.

2. The method of claim 1, wherein the bacterial culture comprises *Pseudomonas chlororaphis* strain 189, International Depositary Authority of Canada accession number 151116-02.

3. The method of claim 1 wherein the plant is a solanaceous crop.

4. The method of claim 1 wherein the plant is potato.

5. The method of claim 1 wherein the plant is tomato.

6. The method of claim 1 wherein the biopesticidal formulation is applied by spraying.

7. The method of claim 1 wherein the biopesticidal formulation is applied to plants growing in a field.

8. The method of claim 1 wherein the biopesticidal formulation is applied to plants under cultivation in greenhouses or glasshouses.

9. The method of claim 1 wherein the biopesticidal formulation is applied to tubers prior to or during storage.

10. The method of claim 9 wherein the tubers are potato tubers.

11. The method of claim 1 wherein the biopesticidal formulation is applied to fruit before harvest.

12. The method of claim 11 wherein the fruit is tomato fruit.

13. A method of controlling or treating potato late blight disease in plants, the method comprising applying an effective amount of a biopesticidal formulation to a plant, or part thereof, infected by, or at risk of infection by, *Phytophthora infestans*, the biopesticidal formulation comprising a bacterial culture and a carrier, wherein the bacterial culture comprises an effective amount of one or more bacteria selected from the group consisting of:

*Pseudomonas chlororaphis* strain 189, International Depositary Authority of Canada accession number 151116-02;

*Bacillus subtilis* strain WAUSV36, International Depositary Authority of Canada accession number 151116-01;

*Pseudomonas fluorescens* strain UWO1, International Depositary Authority of Canada accession number 151116-03;

*Pseudomonas fluorescens* strain KENGFT3, International Depositary Authority of Canada accession number 151116-05;

*Arthrobacter* sp. strain OY3WO11, International Depositary Authority of Canada accession number 151116-04; and

*Pantoea sp.* strain OXWO6B1, International Depositary Authority of Canada accession number 151116-06.

14. The method of claim 13, wherein the biopesticidal formulation comprises *Pseudomonas chlororaphis* strain 189, International Depositary Authority of Canada accession number 151116-02.

15. The method of claim 13 wherein the plant is a solanaceous crop.

16. The method of claim 13 wherein the plant is potato.

17. The method of claim 13 wherein the plant is tomato.

18. The method of claim 13 wherein the biopesticidal formulation is applied by spraying.

19. The method of claim 13 wherein the biopesticidal formulation is applied to plants growing in a field.

20. The method of claim 13 wherein the biopesticidal formulation is applied to plants under cultivation in greenhouses or glasshouses.

21. The method of claim 13 wherein the biopesticidal formulation is applied to tubers prior to or during storage.

22. The method of claim 21 wherein the tubers are potato tubers.

23. The method of claim 13 wherein the biopesticidal formulation is applied to fruit before harvest.

24. The method of claim 23 wherein the fruit is tomato fruit.

* * * * *